US012692513B2

(12) United States Patent
DeHart et al.

(10) Patent No.: US 12,692,513 B2
(45) Date of Patent: *Jul. 28, 2026

(54) PROSTATE NEOANTIGENS AND THEIR USES

(71) Applicant: Janssen Biotech, Inc., Horsham, PA (US)

(72) Inventors: Jason Lee DeHart, San Diego, CA (US); Vipul Bhargava, Warrington, PA (US); Patrick Wilkinson, Collegeville, PA (US); Manuel Alejandro Sepulveda, West Windsor, NJ (US)

(73) Assignee: Janssen Biotech, Inc., Horsham, PA (US)

( * ) Notice: Subject to any disclaimer, the term of this patent is extended or adjusted under 35 U.S.C. 154(b) by 1167 days.

This patent is subject to a terminal disclaimer.

(21) Appl. No.: 17/366,545

(22) Filed: Jul. 2, 2021

(65) Prior Publication Data

US 2023/0024133 A1 Jan. 26, 2023

Related U.S. Application Data

(60) Provisional application No. 63/048,484, filed on Jul. 6, 2020.

(51) Int. Cl.
*C12N 15/86* (2006.01)
*A61K 39/00* (2006.01)

(52) U.S. Cl.
CPC .......... *C12N 15/86* (2013.01); *A61K 39/0011* (2013.01); *A61K 39/001193* (2018.08); *A61K 2039/5154* (2013.01); *A61K 2039/53* (2013.01); *A61K 2039/545* (2013.01); *A61K 2039/884* (2018.08); *C12N 2710/10343* (2013.01); *C12N 2710/24143* (2013.01); *C12N 2770/36143* (2013.01)

(58) Field of Classification Search
CPC ................ A61K 39/12; A61K 39/0011; A61K 39/001193; A61K 2039/5154; A61K 2039/53; A61K 2039/545; A61K 2039/884; C12N 15/86; C12N 2770/36143
See application file for complete search history.

(56) References Cited

U.S. PATENT DOCUMENTS

| | | | |
|---|---|---|---|
| 4,235,871 | A | 11/1980 | Papahadjopoulos et al. |
| 4,501,728 | A | 2/1985 | Geho et al. |
| 4,603,112 | A | 7/1986 | Paoletti et al. |
| 4,769,330 | A | 9/1988 | Paoletti et al. |
| 4,772,848 | A | 9/1988 | Hummel |
| 4,837,028 | A | 6/1989 | Allen |
| 4,897,445 | A | 1/1990 | Coy et al. |
| 5,100,587 | A | 3/1992 | Clough et al. |
| 5,179,993 | A | 1/1993 | Bak et al. |
| 5,185,146 | A | 2/1993 | Altenburger |
| 5,223,409 | A | 6/1993 | Ladner et al. |
| 5,225,539 | A | 7/1993 | Winter |
| 5,403,484 | A | 4/1995 | Ladner et al. |
| 5,427,908 | A | 6/1995 | Dower et al. |
| 5,559,099 | A | 9/1996 | Wickham et al. |
| 5,571,698 | A | 11/1996 | Ladner et al. |
| 5,580,717 | A | 12/1996 | Dower et al. |
| 5,595,897 | A | 1/1997 | Midoux et al. |
| 5,635,363 | A | 6/1997 | Altman et al. |
| 5,635,483 | A | 6/1997 | Pettit et al. |
| 5,734,023 | A | 3/1998 | Nag et al. |
| 5,744,166 | A | 4/1998 | Illum |
| 5,747,323 | A | 5/1998 | Darlix et al. |
| 5,780,588 | A | 7/1998 | Pettit et al. |
| 5,820,866 | A | 10/1998 | Kappler et al. |
| 5,837,511 | A | 11/1998 | Falck-Pedersen et al. |
| 5,846,782 | A | 12/1998 | Wickham et al. |
| 5,851,806 | A | 12/1998 | Kovesdi et al. |
| 5,885,793 | A | 3/1999 | Griffiths et al. |
| 5,891,690 | A | 4/1999 | Massie |
| 5,932,448 | A | 8/1999 | Tso et al. |
| 5,965,541 | A | 10/1999 | Wickham et al. |
| 5,969,108 | A | 10/1999 | McCafferty et al. |
| 5,972,707 | A | 10/1999 | Roy et al. |
| 5,976,551 | A | 11/1999 | Mottez et al. |
| 5,976,567 | A | 11/1999 | Wheeler et al. |
| 5,981,225 | A | 11/1999 | Kochanek et al. |
| 5,981,501 | A | 11/1999 | Wheeler et al. |
| 5,994,106 | A | 11/1999 | Kovesdi et al. |
| 5,994,128 | A | 11/1999 | Fallaux et al. |

(Continued)

FOREIGN PATENT DOCUMENTS

| | | | |
|---|---|---|---|
| CO | 2017012891 | A2 | 3/2018 |
| CO | 2018006023 | A2 | 6/2018 |

(Continued)

OTHER PUBLICATIONS

Cheever MA, Higano CS. Provenge (Sipuleucel-T) in prostate cancer: the first FDA-approved therapeutic cancer vaccine. Clin Cancer Res. Jun. 1, 2011;17(11):3520-6. doi: 10.1158/1078-0432. CCR-10-3126. Epub Apr. 6, 2011. PMID: 21471425. (Year: 2011).*
Ott PA, et al.An immunogenic personal neoantigen vaccine for patients with melanoma. Nature. Jul. 13, 2017;547(7662):217-221. doi: 10.1038/nature22991. Epub Jul. 5, 2017. Erratum in: Nature. Mar. 14, 2018;555(7696):402. doi: 10.1038/nature25145. PMID: 28678778; PMCID: PMC5577644. (Year: 2017).*
Matsushita M, Fujita K, Nonomura N. Influence of Diet and Nutrition on Prostate Cancer. Int J Mol Sci. Feb. 20, 2020;21(4):1447. doi: 10.3390/ijms21041447. PMID: 32093338; PMCID: PMC7073095. (Year: 2020).*
Hamilton Z, Parsons JK. Prostate Cancer Prevention: Concepts and Clinical Trials. Curr Urol Rep. Apr. 2016;17(4):35. doi: 10.1007/s11934-016-0587-1. PMID: 26957512. (Year: 2016).*

(Continued)

*Primary Examiner* — Hong Sang
*Assistant Examiner* — Carol Ann Chase
(74) *Attorney, Agent, or Firm* — BakerHostetler

(57) ABSTRACT

Disclosed herein are self-replicating RNA molecules encoding prostate neoantigens, vaccines, and method of treating and preventing prostate cancer using the self-replicating RNA molecules and vaccines.

9 Claims, 15 Drawing Sheets

Specification includes a Sequence Listing.

(56) References Cited

U.S. PATENT DOCUMENTS 6,013,240 A 1/2000 Behr et al.
6,020,191 A 2/2000 Scaria et al.
6,025,337 A 2/2000 Truong et al.
6,040,174 A 3/2000 Imler et al.
6,110,735 A 8/2000 Chartier et al.
6,113,913 A 9/2000 Brough et al.
6,150,584 A 11/2000 Kucherlapati et al.
6,172,197 B1 1/2001 McCafferty et al.
6,197,302 B1 3/2001 Hirsch et al.
6,204,060 B1 3/2001 Mehtali et al.
6,207,195 B1 3/2001 Walsh et al.
6,218,370 B1 4/2001 Bischoff et al.
6,268,411 B1 7/2001 Schneck et al.
6,270,772 B1 8/2001 Burrows et al.
6,312,948 B1 11/2001 Cohen-Haguenauer
6,335,199 B1 1/2002 Bischoff et al.
6,348,584 B1 2/2002 Hodgson et al.
6,440,442 B1 8/2002 Ehrhard et al.
6,521,404 B1 2/2003 Griffiths et al.
6,534,484 B1 3/2003 Wheeler et al.
6,544,731 B1 4/2003 Griffiths et al.
6,555,313 B1 4/2003 Griffiths et al.
6,582,915 B1 6/2003 Griffiths et al.
6,586,410 B1 7/2003 Wheeler et al.
6,593,081 B1 7/2003 Griffiths et al.
6,673,901 B2 1/2004 Koide
6,815,432 B2 11/2004 Wheeler et al.
6,818,749 B1 11/2004 Kashmiri et al.
6,833,441 B2 12/2004 Wang et al.
7,074,904 B2 7/2006 Wong et al.
7,074,905 B2 7/2006 Rhode et al.
7,141,656 B2 11/2006 Rhode et al.
7,264,958 B1 9/2007 Koehl et al.
7,270,811 B2 9/2007 Bout et al.
7,329,731 B2 2/2008 Jakobsen et al.
7,569,664 B2 8/2009 Jakobsen et al.
7,709,226 B2 5/2010 Foote
7,718,369 B2 5/2010 Tomlins et al.
7,871,817 B2 1/2011 Voss et al.
8,133,724 B2 3/2012 Qiu et al.
8,163,293 B2 4/2012 Chaplin
8,211,645 B2 7/2012 Tomlins et al.
8,268,329 B2 9/2012 Chaplin et al.
8,313,740 B2 11/2012 Delcayre et al.
8,377,447 B2 2/2013 Burrows et al.
8,377,688 B2 2/2013 Delcayre et al.
8,394,385 B2 3/2013 Hausmann et al.
8,580,509 B2 11/2013 Tomlins et al.
8,685,660 B2 4/2014 Vogelstein et al.
8,748,356 B2 6/2014 Raghunathan
8,828,379 B2 9/2014 Loset et al.
8,940,290 B2 1/2015 Roy et al.
9,061,059 B2 6/2015 Chakraborty et al.
9,079,941 B2 7/2015 Ovaa et al.
9,133,264 B2 9/2015 Blankenstein et al.
9,146,238 B2 9/2015 Luo et al.
9,150,663 B2 10/2015 Labrijn et al.
9,284,609 B2 3/2016 Tomlins et al.
9,468,672 B2 * 10/2016 Binder ................ C07K 14/705
9,593,077 B2 3/2017 Payne et al.
9,617,560 B2 4/2017 Brough et al.
9,624,292 B2 4/2017 Voss et al.
9,745,635 B2 8/2017 Tomlins et al.
9,750,801 B2 9/2017 Barouch et al.
9,790,256 B2 10/2017 Bunnik et al.
9,884,075 B2 2/2018 Bethune et al.
10,035,832 B2 7/2018 Schlom et al.
10,111,940 B2 10/2018 Mcneel et al.
10,155,031 B2 12/2018 Sahin et al.
10,190,173 B2 1/2019 Tomlins et al.
10,350,275 B2 7/2019 Aguilar-Cordova
10,441,643 B2 10/2019 Pulido et al.
10,512,662 B2 12/2019 Deng et al.
10,532,067 B2 1/2020 Geall et al.
10,548,930 B2 2/2020 Deng et al.
10,640,786 B2 5/2020 Barry et al.
10,736,962 B2 8/2020 Deng et al.
10,781,169 B2 9/2020 Payne et al.
10,973,892 B2 4/2021 Lauterbach et al.
11,110,159 B2 9/2021 Demoitie et al.
11,179,456 B2 11/2021 Dorrell et al.
2001/0036927 A1 11/2001 Bischoff et al.
2001/0049136 A1 12/2001 Imler et al.
2002/0028497 A1 3/2002 Blanche et al.
2002/0192763 A1 12/2002 Xu et al.
2003/0198953 A1 10/2003 Spytek et al.
2005/0244851 A1 11/2005 Blume et al.
2006/0115821 A1 6/2006 Einstein et al.
2007/0148774 A1 6/2007 McCafferty et al.
2007/0287170 A1 12/2007 Davis et al.
2008/0208783 A1 8/2008 Jaros et al.
2008/0254059 A1 * 10/2008 Bett ........................ A61P 37/00
435/235.1
2009/0104225 A1 4/2009 Delcayre et al.
2009/0182127 A1 7/2009 Kjaergaard et al.
2010/0015133 A1 1/2010 Igawa et al.
2010/0143247 A1 6/2010 Fenske et al.
2010/0143302 A1 6/2010 Havenga et al.
2010/0216708 A1 8/2010 Jacobs et al.
2010/0255056 A1 10/2010 Jacobs et al.
2010/0261620 A1 10/2010 Almagro et al.
2010/0286374 A1 11/2010 Kannan et al.
2011/0123532 A1 5/2011 Gurney et al.
2011/0300205 A1 12/2011 Geall et al.
2012/0015839 A1 1/2012 Chinnaiyan
2012/0093934 A1 4/2012 Santamaria
2012/0252742 A1 10/2012 Kranz et al.
2012/0296070 A1 11/2012 Tomlins et al.
2013/0289253 A1 10/2013 Luescher et al.
2013/0330335 A1 12/2013 Bremel et al.
2014/0271829 A1 9/2014 Lilja et al.
2014/0303356 A1 10/2014 Gramer et al.
2015/0329617 A1 11/2015 Winther et al.
2015/0344965 A1 12/2015 Luo et al.
2016/0078168 A1 3/2016 Zhuo et al.
2016/0130319 A1 5/2016 Li
2016/0271239 A1 9/2016 Foy et al.
2017/0003288 A1 1/2017 Heath et al.
2017/0039314 A1 2/2017 Bremel et al.
2017/0095544 A1 4/2017 Santamaria
2017/0106065 A1 4/2017 Foy et al.
2017/0121409 A1 5/2017 Verona et al.
2017/0182139 A1 6/2017 Mcneel et al.
2017/0266270 A1 9/2017 Foy et al.
2017/0334963 A1 11/2017 Johnston
2018/0000912 A1 1/2018 Meruelo et al.
2018/0002393 A1 1/2018 Bancel et al.
2018/0028626 A1 2/2018 Slos et al.
2018/0064803 A1 3/2018 Tomaka et al.
2018/0104359 A1 4/2018 Kamrud
2018/0118849 A1 5/2018 Klein et al.
2018/0126003 A1 5/2018 Hoerr
2018/0141998 A1 5/2018 Nguyen et al.
2018/0153975 A1 6/2018 Fritsch et al.
2018/0171340 A1 6/2018 Kamrud et al.
2018/0311269 A1 11/2018 Obb et al.
2019/0030147 A1 1/2019 Artomov et al.
2019/0038732 A1 2/2019 Mcneel et al.
2019/0041771 A1 2/2019 Chang
2019/0093085 A1 3/2019 Tufaro et al.
2019/0192691 A1 6/2019 Gladstone et al.
2019/0350993 A1 11/2019 Cai
2019/0351040 A1 11/2019 Valiante et al.
2020/0054728 A1 2/2020 Artomov et al.
2020/0061174 A1 2/2020 Kalla et al.
2020/0121774 A1 4/2020 Lubaroff et al.
2020/0138923 A1 5/2020 Bendjama et al.
2020/0148742 A1 5/2020 Grandi et al.
2020/0171151 A1 6/2020 Yeung
2020/0197500 A1 6/2020 Blair et al.
2020/0222478 A1 7/2020 Bachman et al.
2020/0222519 A1 7/2020 Nicosia et al.
2020/0239906 A1 7/2020 Roeth et al.
2020/0283497 A1 9/2020 Oehm et al.

(56) References Cited

U.S. PATENT DOCUMENTS

| | | | |
|---|---|---|---|
| 2020/0299725 | A1 | 9/2020 | Beissert et al. |
| 2020/0306352 | A1 | 10/2020 | Hochrein et al. |
| 2020/0330534 | A1 | 10/2020 | Delgoffe et al. |
| 2020/0339959 | A1 | 10/2020 | Deng et al. |
| 2021/0015878 | A1 | 1/2021 | Larson et al. |
| 2021/0023100 | A1 | 1/2021 | Sahin et al. |
| 2021/0046130 | A1 | 2/2021 | Jia et al. |
| 2021/0069322 | A1 | 3/2021 | Ammendola et al. |
| 2021/0130848 | A1 | 5/2021 | Nicosia et al. |
| 2021/0238244 | A1 | 8/2021 | Plasterk |
| 2021/0361760 | A1 | 11/2021 | Philip |

FOREIGN PATENT DOCUMENTS

| | | | |
|---|---|---|---|
| CO | 2018007417 | A2 | 9/2018 |
| CO | 2019006541 | A2 | 6/2019 |
| CO | 2019012345 | A2 | 1/2020 |
| CO | 2019013609 | A2 | 4/2020 |
| CO | 2021004019 | A2 | 7/2021 |
| CO | 2021009307 | A2 | 8/2021 |
| EP | 0901463 | A1 | 3/1999 |
| EP | 0919627 | A2 | 6/1999 |
| EP | 1230354 | A2 | 8/2002 |
| EP | 1670823 | A1 | 6/2006 |
| EP | 1882700 | A1 | 1/2008 |
| EP | 2061807 | A2 | 5/2009 |
| EP | 1934363 | B1 | 3/2013 |
| EP | 3215164 | A1 | 9/2017 |
| EP | 3286210 | A1 | 2/2018 |
| EP | 3721899 | A1 | 10/2020 |
| WO | 88/01649 | A1 | 3/1988 |
| WO | 90/04036 | A1 | 4/1990 |
| WO | 90/07861 | | 7/1990 |
| WO | 92/01047 | A1 | 1/1992 |
| WO | 92/22653 | A1 | 12/1992 |
| WO | 94/13804 | A1 | 6/1994 |
| WO | 95/01447 | A1 | 1/1995 |
| WO | 95/24221 | A1 | 9/1995 |
| WO | 96/02655 | A1 | 2/1996 |
| WO | 96/17070 | A1 | 6/1996 |
| WO | 96/19240 | A1 | 6/1996 |
| WO | 96/27011 | A1 | 9/1996 |
| WO | 96/27677 | A2 | 9/1996 |
| WO | 96/40964 | A2 | 12/1996 |
| WO | 97/04119 | A1 | 2/1997 |
| WO | 97/35996 | A1 | 10/1997 |
| WO | 98/00524 | A1 | 1/1998 |
| WO | 98/26048 | A1 | 6/1998 |
| WO | 98/34910 | A1 | 8/1998 |
| WO | 98/37916 | A1 | 9/1998 |
| WO | 98/39411 | A1 | 9/1998 |
| WO | 98/44001 | A1 | 10/1998 |
| WO | 99/45962 | A1 | 9/1999 |
| WO | 00/50573 | A1 | 8/2000 |
| WO | 00/70071 | A1 | 11/2000 |
| WO | 01/30382 | A1 | 5/2001 |
| WO | 01/30847 | A1 | 5/2001 |
| WO | 02/43478 | A2 | 6/2002 |
| WO | 02/66630 | A1 | 8/2002 |
| WO | 02/88172 | A2 | 11/2002 |
| WO | 2003/076610 | A2 | 9/2003 |
| WO | 2004/044176 | A2 | 5/2004 |
| WO | 2004/113571 | A2 | 12/2004 |
| WO | 2005/046621 | A2 | 5/2005 |
| WO | 2005/048957 | A2 | 6/2005 |
| WO | 2005/051991 | A2 | 6/2005 |
| WO | 2005/071093 | A2 | 8/2005 |
| WO | 2006/056766 | A2 | 6/2006 |
| WO | 2007/104792 | A2 | 9/2007 |
| WO | 2007/147901 | A1 | 12/2007 |
| WO | 2008/106615 | A1 | 9/2008 |
| WO | 2009/006479 | A2 | 1/2009 |
| WO | 2009/065546 | A1 | 5/2009 |
| WO | 2009/085462 | A1 | 7/2009 |
| WO | 2009/127060 | A1 | 10/2009 |
| WO | 2009/134776 | A2 | 11/2009 |
| WO | 2010/081001 | A2 | 7/2010 |
| WO | 2010/086189 | A2 | 8/2010 |
| WO | 2010/132867 | A1 | 11/2010 |
| WO | 2011/005799 | A2 | 1/2011 |
| WO | 2011/068810 | A1 | 6/2011 |
| WO | 2011/143545 | A1 | 11/2011 |
| WO | 2012/006369 | A2 | 1/2012 |
| WO | 2012/006372 | A1 | 1/2012 |
| WO | 2012/006376 | A2 | 1/2012 |
| WO | 2012/006378 | A1 | 1/2012 |
| WO | 2012/022811 | A1 | 2/2012 |
| WO | 2012/030901 | A1 | 3/2012 |
| WO | 2012/031043 | A1 | 3/2012 |
| WO | 2012/089225 | A1 | 7/2012 |
| WO | 2012/089338 | A1 | 7/2012 |
| WO | 2012/149522 | A1 | 11/2012 |
| WO | 2012/172277 | A1 | 12/2012 |
| WO | 2012/177624 | A2 | 12/2012 |
| WO | 2013/006825 | A1 | 1/2013 |
| WO | 2013/006838 | A1 | 1/2013 |
| WO | 2013/006842 | A2 | 1/2013 |
| WO | 2013/033563 | A1 | 3/2013 |
| WO | 2013/096291 | A2 | 6/2013 |
| WO | 2013/116778 | A2 | 8/2013 |
| WO | 2013/151672 | A2 | 10/2013 |
| WO | 2013/157954 | A1 | 10/2013 |
| WO | 2013/176772 | A1 | 11/2013 |
| WO | 2014/127917 | A1 | 8/2014 |
| WO | 2015/069571 | A1 | 5/2015 |
| WO | 2015/069770 | A1 | 5/2015 |
| WO | 2015/077624 | A1 | 5/2015 |
| WO | 2015/078856 | A1 | 6/2015 |
| WO | 2015/103037 | A2 | 7/2015 |
| WO | 2015/123496 | A1 | 8/2015 |
| WO | 2015/164674 | A1 | 10/2015 |
| WO | 2015/175334 | A2 | 11/2015 |
| WO | 2015/175340 | A1 | 11/2015 |
| WO | 2015/176033 | A1 | 11/2015 |
| WO | 2015/192068 | A1 | 12/2015 |
| WO | 2016/046357 | A1 | 3/2016 |
| WO | 2016/128542 | A1 | 8/2016 |
| WO | 2016/170176 | A1 | 10/2016 |
| WO | 2016/184822 | A1 | 11/2016 |
| WO | 2016/187508 | A2 | 11/2016 |
| WO | 2016/197067 | A1 | 12/2016 |
| WO | 2016/203025 | A1 | 12/2016 |
| WO | 2016/207164 | A2 | 12/2016 |
| WO | 2017/001491 | A2 | 1/2017 |
| WO | 2017/015064 | A1 | 1/2017 |
| WO | 2017/020026 | A1 | 2/2017 |
| WO | 2017/070110 | A1 | 4/2017 |
| WO | 2017/070618 | A1 | 4/2017 |
| WO | 2017/091905 | A1 | 6/2017 |
| WO | 2017/106638 | A1 | 6/2017 |
| WO | 2017/147554 | A2 | 8/2017 |
| WO | 2017/173321 | A1 | 10/2017 |
| WO | 2017/177207 | A1 | 10/2017 |
| WO | 2017/180587 | A2 | 10/2017 |
| WO | 2017/180770 | A1 | 10/2017 |
| WO | 2017/201325 | A1 | 11/2017 |
| WO | 2017/201350 | A1 | 11/2017 |
| WO | 2017/201352 | A1 | 11/2017 |
| WO | 2017/205810 | A1 | 11/2017 |
| WO | 2017/210562 | A1 | 12/2017 |
| WO | 2017/220499 | A1 | 12/2017 |
| WO | 2018/033254 | A2 | 2/2018 |
| WO | 2018/037085 | A1 | 3/2018 |
| WO | 2018/046803 | A1 | 3/2018 |
| WO | 2018/075235 | A1 | 4/2018 |
| WO | 2018/081480 | A1 | 5/2018 |
| WO | 2018/093907 | A1 | 5/2018 |
| WO | 2018/098362 | A1 | 5/2018 |
| WO | 2018/102584 | A1 | 6/2018 |
| WO | 2018/102585 | A1 | 6/2018 |
| WO | 2018/107011 | A1 | 6/2018 |
| WO | 2018/143949 | A1 | 8/2018 |
| WO | 2018/144082 | A1 | 8/2018 |
| WO | 2018/146205 | A1 | 8/2018 |

(56) References Cited

FOREIGN PATENT DOCUMENTS

| | | | |
|---|---|---|---|
| WO | 2018/148381 | A1 | 8/2018 |
| WO | 2018/148501 | A1 | 8/2018 |
| WO | 2018/161092 | A1 | 9/2018 |
| WO | 2018/167320 | A1 | 9/2018 |
| WO | 2018/187356 | A2 | 10/2018 |
| WO | 2018/195357 | A1 | 10/2018 |
| WO | 2018/223093 | A1 | 12/2018 |
| WO | 2019/008111 | A1 | 1/2019 |
| WO | 2019/012082 | A1 | 1/2019 |
| WO | 2019/012091 | A1 | 1/2019 |
| WO | 2019/023566 | A1 | 1/2019 |
| WO | 2019/046377 | A1 | 3/2019 |
| WO | 2019/053056 | A1 | 3/2019 |
| WO | 2019/086615 | A1 | 5/2019 |
| WO | 2019/094396 | A1 | 5/2019 |
| WO | 2019/115816 | A1 | 6/2019 |
| WO | 2019/134048 | A1 | 7/2019 |
| WO | 2019/135086 | A1 | 7/2019 |
| WO | 2019/137999 | A1 | 7/2019 |
| WO | 2019/143949 | A2 | 7/2019 |
| WO | 2019/152922 | A1 | 8/2019 |
| WO | 2019/191780 | A1 | 10/2019 |
| WO | 2019/219851 | A1 | 11/2019 |
| WO | 2019/226939 | A1 | 11/2019 |
| WO | 2019/226941 | A1 | 11/2019 |
| WO | 2019/232103 | A1 | 12/2019 |
| WO | 2019/238023 | A1 | 12/2019 |
| WO | 2020/003126 | A1 | 1/2020 |
| WO | 2020/014539 | A1 | 1/2020 |
| WO | 2020/022898 | A2 | 1/2020 |
| WO | 2020/025642 | A1 | 2/2020 |
| WO | 2020/048990 | A1 | 3/2020 |
| WO | 2020/056424 | A1 | 3/2020 |
| WO | 2020/070303 | A1 | 4/2020 |
| WO | 2020/072371 | A1 | 4/2020 |
| WO | 2020/073045 | A1 | 4/2020 |
| WO | 2020/079234 | A1 | 4/2020 |
| WO | 2020/096640 | A2 | 5/2020 |
| WO | 2020/097291 | A1 | 5/2020 |
| WO | 2020/097393 | A1 | 5/2020 |
| WO | 2020/099614 | A1 | 5/2020 |
| WO | 2020/104531 | A1 | 5/2020 |
| WO | 2020/121273 | A1 | 6/2020 |
| WO | 2020/123912 | A1 | 6/2020 |
| WO | 2020/131586 | A2 | 6/2020 |
| WO | 2020/132275 | A1 | 6/2020 |
| WO | 2020/143634 | A1 | 7/2020 |
| WO | 2020/144614 | A1 | 7/2020 |
| WO | 2020/144615 | A1 | 7/2020 |
| WO | 2020/150152 | A1 | 7/2020 |
| WO | 2020/154189 | A1 | 7/2020 |
| WO | 2020/205412 | A1 | 10/2020 |
| WO | 2020/243719 | A1 | 12/2020 |
| WO | 2020/247547 | A1 | 12/2020 |
| WO | 2022/009049 | A1 | 1/2022 |
| WO | 2022/009051 | A1 | 1/2022 |
| WO | 2023/111861 | A1 | 6/2023 |

OTHER PUBLICATIONS

Sewell AK. Why must T cells be cross-reactive? Nat Rev Immunol. Sep. 2012;12(9):669-77. doi: 10.1038/nri3279. PMID: 22918468; PMCID: PMC7097784. (Year: 2012).*

Peters B, Nielsen M, Sette A. T Cell Epitope Predictions. Annu Rev Immunol. Apr. 26, 2020;38:123-145. doi: 10.1146/annurev-immunol-082119-124838. Epub Feb. 11, 2020. PMID: 32045313; PMCID: PMC10878398. (Year: 2020).*

Arlen PM et al.Clinical safety of a viral vector based prostate cancer vaccine strategy. J Urol. Oct. 2007;178(4 Pt 1):1515-20. doi: 10.1016/j.juro.2007.05.117. Epub Aug. 16, 2007. PMID: 17707059. (Year: 2007).*

Buonaguro L, Tagliamonte M. Peptide-based vaccine for cancer therapies. Front Immunol. Aug. 16, 2023;14:1210044. doi: 10.3389/fimmu.2023.1210044. Erratum in: Front Immunol. Oct. 26, 2023;14:1324894. doi: 10.3389/fimmu.2023.1324894. PMID: 37654484; PMCID: PMC10467431. (Year: 2023).*

Yamada et al., Next-generation peptide vaccines for advanced cancer, Cancer Science, Dec. 4, 2012, vol. 104, No. 1, pp. 15-21.

Ahl et al., "Enhancement of the in vivo circulation lifetime of L-a-distearoylphosphatidylcholine liposomes: importance of liposomal aggregation versus complement opsonization", Biochim. Biophys. Acta, 1997, 1329, 370-382.

Akimaru et al., "Formulation and antitumor efficacy of liposomal-caprylated-TNF-SAM2.", Cytokines Mol. Ther., 1995, pp. 197-210, vol. 1(3).

Altschul et al., "BLAST—(see, for example), in Basic Local Alignment Search Tool", J. Mol. Biol., 1993, 215, 403-410.

Alving et al., "Liposomes as carriers of peptide antigens: induction of antibodies and cytotoxic T lymphocytes to conjugated and unconjugated peptides.", 1995, Immunol. Rev., 1995, pp. 5-31, vol. 145.

Armenia Joshua et al: The long tail of oncogenic drivers in prostate cancer, Nature Genetics, Nature Publishing Group, New York, US, vol. 50, No. 5, Apr. 2, 2018 (Apr. 2, 2018), pp. 645-651.

Bakker et al., "Conditional MHC class I ligands and peptide exchange technology for the human MHC gene products HLA-A1, -A3, -A11, and -B7.", Proc Natl Acad Sci, USA, Mar. 22, 2008, pp. 3825-3830, vol. 105(10).

Behr et al., "Efficient gene transfer into mammalian primary endocrine cells with lipopolvamine-coated DNA.", Proc. Natl. Acad. Sci., USA, 1999, pp. 6982-6986, vol. 86(18).

Bri.iggemann and Taussig, "Production of human antibody repertoires in transgenic mice.", Curr Opin Biotechnol, 1997, pp. 455-458, vol. 8.

Bri.iggemann et al., "Human antibody production in transgenic mice: expression from 100 kb of the human lqH locus*.", Eur J Immunol, 1991, pp. 1323-1326, vol. 21.

Bruckdorfer et al, "From Production of Peptides in Milligram Amounts for Research to Multi-Tons Quantities for Drugs of the Future," Current Pharmaceutical Biotechnology, vol. 5, Issue 1, 2004, pp. 29-43.

Chothia and Lesk, "Canonical Structures for the Hypervariable Regions of Immunoglobulins.", Mol Biol, 1987, pp. 901-917, vol. 196.

Correa, Ricardo G et al: 'The NLR-related protein NWD1 is associated with prostate cancer and modulates androgen receptor signaling'1, ON CO TA PG ET, Mar. 26, 2014 (Mar. 26, 2014), pp. 1666-1682.

Danner, Mayr A., "Vaccination against pox diseases under immunosuppressive conditions"., Dev. Biol. Stand., 1978, pp. 225-234, vol. 41.

Danos and Mulligan, "Safe and efficient generation of recombinant retroviruses with amphotropic and ecotropic host ranges.", Proc. Natl. Acad. Sci., USA, 1988, pp. 6460-6464, vol. 85(17).

Feigner, et al., "Cationic Lipid-Mediated Delivery of Polynucleotides. ", Methods, 1993, pp. 67-75, vol. 5.

Felgner et al., "Lipofection: A highly efficient, lipid-mediated DNA-transfection procedure", Proc. Natl. Acad. Sci. USA, 1987, 84, 7413-7417.

Fishwild et al., "High-avidity human IgGk monoclonalantibodies from a novel strain of minilocus transqenic mice.", Nat Biotechnol, Jul. 1996, pp. 845-851, vol. 14.

Gao X. et al, "A novel cationic liposome reagent for efficient transfection of mammalian cells," Biochemical and Biophysical Research Communications, vol. 179, Issue 1, Aug. 30, 1991, pp. 280-285.

Ge et al., "FusionMap: detecting fusion genes from next-generation sequencing data at base-pair resolution.", Bioinformatics. Jul. 15, 2011;27(14):1922-8. doi: 10.1093/bioinformatics/btr310. Epub May 18, 2011.

Geall et al.,"Nonviral delivery of self-amplifying RNA vaccines," PNAS, vol. 109, 2012, pp. 14604-14609.

Gilboa et al., "Retroviral Gene Transfer: Applications To Human Therapy.", Adv. Exp. Med. Biol., 1988, pp. 29-33, vol. 241.

Goding, Monoclonal Antibodies: Principles and Practice, Chapter 3, pp. 59-103, Academic Press, 1986.

(56) References Cited

OTHER PUBLICATIONS

Gorchakov R, et al., "Different Types of nsP3-Containing Protein Complexes in Sindbis Virus-Infected Cells," Journal of Virology, vol. 82, Issue 20, 2008, pp. 10088-10101.
Graham et al., "Characteristics of a Human Cell Line Transformed by DNA from Human Adenovirus Type 5.", J. Gen. Viral., 1977, pp. 59-72, vol. 36.
Green and Jakobovits, "Regulation of B Cell Development by Variable Gene Complexity in Mice Reconstituted with Human Immunoglobulin Yeast Artificial Chromosomes.", J. Exp. Med., Aug. 1998, pp. 483-495, vol. 188(3).
Green et al., "Antigen-specific human monoclonal antibodies from mice engineered with human Iq heavy and light chain YACs.", Nature Genet., 1994, pp. 13-21, vol. 7.
Green, L., "Antibody engineering via genetic engineering of the mouse: XenoMouse strains are a vehicle for the facile generation of therapeutic human monoclonal antibodies.", J Immunol Methods, 1999, pp. 11-23, vol. 231.
Haensler et al., "Polyamidoamine Cascade Polymers Mediate Efficient Transfection of Cells in Culture", Bioconjugate Chem., 1993, 4, 372-379.
Hoganson, D.K., et al., "Development of a Stable Adenoviral Vector Formulation," Bioprocessing, Technical Developments and Opportunities; vol. 1, No. 1, Mar. 2002, pp. 43-48.
Honegger and Pluckthun, "Yet Another Numbering Scheme for Immunoglobulin Variable Domains: An Automatic Modeling and Analysis Tool.", J Mol Biol, 2001, pp. 657-670, vol. 309.
Hoogenboom and Winter, "By-passing Immunisation. Human Antibodies from Synthetic Repertoires of Germline VH Gene Segments Rearranged in Virto.", J Mol Biol, 1992, pp. 381-388, vol. 227.
Hosse et al., "A New Generation of Protein Display Scaffolds for Molecular Recognition.", Protein Sci., 2006, DD. 14-27, vol. 15.
Juliano. R.L. et al., "The effect of particle size and charge on the clearance rates of liposomes and liposome encapsulated drugs," Biochem. Biophys. Res. Commun, vol. 63, Issue 3, 1975, pp. 651-658.
Kim et al., "Enhancement of protein expression by alphavirus replicons by designing self-replicating subgenomic RNAs," PNAS, vol. 111, 2014, pp. 10708-10713.
Knappik et al., "Fully Snythetic Human Combinatorial Antibody Libraries (HuCAL) Based on Modular Consensus Frameworks and CDRs Randomized with Trinucleotides.", J Mol Biol, 2000, DD. 57-86, vol. 296.
Kohler and Milstein, "Continuous cultures of fused cells secreting antibody of predefined specificitv.", Nature, 1975, DD.495-497, vol. 256.
Krebs et al., "High-Throughput generation and engineering of recombinant human antibodies.", J Immunol Meth, 2001, DD. 67-84, vol. 254.
Kroughak and Graham, "Development of Cell Lines Capable of Complementing E1, E4, and Protein IX Defective Adenovirus Type 5 Mutants.", Human Gene Ther., Dec. 1, 1995, pp. 1575-1586, vol. 6(12).
Le et al., "PD-1 Blockade in Tumors with Mismatch-Repair Deficiency.", N Engl J Med., Jun. 25, 2015, pp. 2509-2520, vol. 372(26), Epub May 30, 2015.
Lefranc et al., "IMGT unique numbering for immunoglobulin and T cell receptor variable domains and Ig superfamily V-like domains.", Dev Comparat Immunol, 2003, pp. 55-77, vol. 27.
Lonberg and Huszar, "Human Antibodies from Transgenic Mice.", Int Rev Immunol, 1995, pp. 65-93, vol. 13.
Lonberg et al., "Antigen-specific human antibodies from mice comprising four distinct genetic modifications.", Nature, 1994, pp. 856-859, vol. 368.
Lopata, et al., "High level trasient expression of a chloramphenicol acetyl transferase gene by DEAE-dextran mediated DNA transfection coupled with a dimethyl sulfoxide or glycerol shock treatment.", 1984, Nucleic Acid Res., 1984, DD. 5707-5717, vol. 12(14).
Lukas et al, "Solid-phase peptide synthesis under continuous-flow conditions," Proc.Nati.Acad.Sci.USA, vol. 78, Issue 5, 1981, pp. 2791-2795.
Lusky, et al., "In Vitro and In Vivo Biology of Recombinant Adenovirus Vectors with E1, E1/E2A, or E1/E4 Deleted.", J. Viral., Mar. 1998, pp. 2022-2032, vol. 72(3).
Markowitz et al., "Construction and use of a safe and efficient amphotropic packaging cell line.", Virology, 1988, pp. 400-406, vol. 167(2).
Marks et al., "By-passing Immunization. Human antibodies from V-gene Libraries Displayed on Phage.", J Mol Biol, 1991, pp. 581-587, vol. 222.
Martin and Thornton, "Structural Families in Loops of Homologous Proteins: Automatic Classification, Modelling and Application to Antibodies.", J Bmol Biol, 1996, pp. 800-815, vol. 263.
Mayr et al., "Vaccination against pox diseases under immunosuppressive conditions", Dev. Biol. Stand., 1978, 41, 225-234.
Mclachlan et al., "Evaluation in vitro and in vivo of cationic liposome-expression construct complexes for cystic fibrosis gene therapy.", Gene Therapy, 1995, pp. 614-622, vol. 2(9).
Aldous et al., "Personalized neoantigen vaccines: A new approach to cancer immunotherapy", Bioorganic & Medicinal Chemistry, 2018, vol. 26, pp. 2842-2849.
Antonarakis, "Cyclin-Dependent Kinase 12, Immunity, and Prostate Cancer", NEJM, 2018, vol. 379, No. 13, pp. 1087-1089.
Cappuccini et al., "5T4 oncofoetal glycoprotein: an old target for a novel prostate cancer immunotherapy", Oncotarget, 2017, vol. 8, No. 29, pp. 47474-47489.
Cappuccini et al., "Immunogenicity and efficacy of the novel cancer vaccine based on simian adenovirus and MVA vectors alone and in combination with PD-1 mAb in a mouse model of prostate cancer", Cancer Immunol Immunotherapy, 2016, vol. 65, pp. 701-713.
Cappuccini et al., "Safety and immunogenicity of novel 5T4 viral vectored vaccination regimens in early stage prostate cancer: a phase I clinical trial", Journal for Immunotherapy of Cancer, 2020, vol. 8, e000928, pp. 1-13.
Gadi et al., "In vivo sensitization of ovarian tumors to chemotherapy by expression of *E. coli* purine nucleoside phosphorylase in a small fraction of cells", 7 Gene Ther., 2000, vol. 7, No. 20, pp. 1738-1743.
Gomes et al., "STEAP 1 is overexpressed in prostate cancer and prostatic intraepithelial neoplasia lesions, and it is positively associated with Gleason score", Urologic Oncology, 2014, vol. 32, pp. 53.e26-53.e29.
Graff et al., "Sipuleucel-T in the treatment of prostate cancer: an evidence based review of its place in therapy", Core Evidence, 2015, pp. 1-10.
Heninger et al., "Inducible expression of cancer-testis antigens in human prostate cancer", Oncotarget, 2016, vol. 7, No. 51, pp. 84359-84374.
Kabat et al., Sequences of Proteins of Immunological Interest, 5th Ed. Public Health Service, National Institutes of Health, Bethesda, Md., 1991, pp. 1-2.
Lundblad, Chemical Reagents for Protein Modification, 3rd ed., CRC Press, 2004, pp. 1-232.
Woyke et al., "In Vitro Activities and Postantifungal Effects of the Potent Dolastatin 10 Derivative Auristatin PHE", Antimicrob agents and chemother., 2001, vol. 45, No. 12, pp. 3580-3584.
Yadav et al., "Predicting immunogenic tumour mutations by combining mass spectrometry and exome sequencing", Nature, 2014, vol. 515, pp. 572-576.
Harrop et al., "Recombinant viral vectors: Cancer vaccines", Advanced Drug Delivery Reviews, 2006, vol. 58, pp. 931-947.
Karan, Formulation of the bivalent prostate cancer vaccine with surgifoam elicits antigen-specific effector T cells in PSA-transgenic mice, Vaccine, vol. 35, Published Sep. 20, 2017, pp. 5794-5798.
Kubler, et al., "Self-adjuvanted mRNA vaccination in advanced protate cancer patients: a first-in-in phase I/IIa study", Journal for Immuno Therapy of Cancer, vol. 3, 26, Jun. 16, 2015.
Rickman et al., SLC45A3-ELK4 is a Novel and Frequent ETS Fusion Transcript in Prostate Cancer, Cancer Res., Published Apr. 1, 2009, pp. 2734-2738.

(56) References Cited

OTHER PUBLICATIONS

Westdorp et al., "Immunotherapy for prostate cancer: lessons from responses to tumor-associated antigens", Frontiers in Immunology, vol. 5, Published May 6, 2014, pp. 1-15.
Ying et al., "Cancer Therapy using a self-replicating RNA vaccine", Nat Med., Published Jul. 1999, pp. 823-827.
Meisinger-Henschel et al., "Genomic sequence of chorioallantois vaccinia virus Ankara, the ancestor of modified vaccinia virus.", J. Gen. Virol., Dec. 2007, pp. 3249-3259, vol. 88, Part 12.
Mendez et al., "Functional transplant of megabase human immunoglobulin loci recapitulates human antibody response in mice.", Nat Genet., Feb. 1997, DD. 146-156, vol. 15.
Meyer, H. et al., "Mapping of deletions in the genome of the highly attenuated vaccinia virus MVA and their influence on virulence", J. Gen. Virol. 72, 1991, 1031-1038.
Meyers et al., "Optimal alignments in linear space," Comput Appl Biosci, vol. 4, 1988, pp. 11-17.
Miller et al., "Improved Retroviral Vectors for Gene Transfer and Expression", BioTechniques, 1989, 7, 980-990.
Myers. E. W. et al, "Optimal alignments in linear space," Bioinformatics, vol. 4, Issue 1, Mar. 1988, pp. 11-17.
Needleman and Wunsch JMol Biol 48:444-453 (1970)).
Nicaise et al., "Affinity Transfer by CDR Grafting on a Nonimmunoglobulin Scaffold.", Protein Sci., 2004, pp. 1882-1891, vol. 13.
Nygren and Uhlen, "Scaffolds for Engineering Novel Binding Sites in Proteins," Curr. Opin. Struc. Biol., 1997, pp. 463-469, vol. 7.
Padlan, E., "A Possible Procedure For Reducing The Immunogenicity of Antibody Variable Domains While Preserving Their Ligand-Binding Properties.", Mol Immunol, 1991, pp. 489-499, vol. 28(4/5).
Parisa M. et al., "Neoantigen screening identifies broad TP53 mutant immunogenicity in patients with epithelial cancers," J Clin Invest, vol. 129, Issue 3, Mar. 2019, pp. 1109-1114.
Piccini et al., "Vaccina Virus as an Expression Vector.", Methods of Enzymology, 1987, pp. 545-563, vol. 153.
Quetglas J I et al., "Alphavirus vectors for cancer therapy," Virus Research, Amsterdam, NL, vol. 153, Issue 2, Nov. 1, 2010, pp. 179-196.
Rizvi et al., "Mutational landscape determines sensitivity to PD-1 blockade in non-small cell lung cancer.", Science, Apr. 3, 2015, pp. 124-128, vol. 348(6230), Epub Mar. 12, 2015.
Robinson et al., "Integrative Clinical Genomics of Advanced Prostate Cancer.", Cell, May 21, 2015, DD. 1215-1228, vol. 161(5).
Rodenko et al., "Generation of peptide-MHC class I complexes through UV-mediated ligand exchange.", Nature Protocols, 2006, pp. 1120-1132, vol. 1(3).
Romani et al., "Presentation of exogenous protein antigens by dendritic cells to T cell clones. Intact protein is presented best by immature, epidermal Langerhans cells.", J. Exp. Med., Mar. 1, 1989, pp. 1169-1178, vol. 169(3).
Sheets et al., "Efficient construction of a large nonimmune phage antibody library: The production of high-affinity human single-chain antibodies to protein antigens.", PTAS (USA), May 1998, DD. 6157-6162, vol. 95.
Shi et al., "De Novo Selection of High-Affinity Antibodies from Synthetic Fab Libraries Displayed on Phage as pIX Fusion Proteins.", J Mol Biol, 2010, pp. 385-396, vol. 397.
Skerra, A., "Alternative Non-Antibody Scaffolds for Molecular Recognition,", Curr. Opin. Biotechnol., 2005, pp. 295-304, vol. 18.
Snyder et al., "Genetic Basis for Clinical Response to CTLA-4 Blockade in Melanoma.", N Enal J Med., Dec. 4, 2014, pp. 2189-2199, vol. 371(23):2189-2199, Epub Nov. 19, 2014.
Sun et al., "An enhanced immune response against G250, induced by a heterologous DNA prime-protein boost vaccination, using polyethyleneimine as a DNA vaccine adjuvant", Mol. Med. Rep., 2014, 10(5), 2657-2662.
Szoka, "Comparative Properties and Methods of Preparation of Lipid Vesicles (Liposomes)I", Ann. Rev. Biophys. Bioeng.,1980, 9, 467-508.
The Cancer Genome Atlas Research Network, "The Molecular taxonomy of primary prostate cancer.", Cell, Nov. 5, 2015, DD. 1011-1025, vol. 163(4).
Tim Beissert et al., "Improvement of In Vivo Expression of Genes Delivered by Self-Amplifying RNA Using vaccinia Virus Immune Evasion Proteins," Homan Gene Therapy, vol. 28, Issue 12, Dec. 1, 2017, pp. 1138-1146.
Toebes et al., "Design and use of conditional MHC class I ligands.", Nat Med, Mar. 2006, pp. 246-251, vol. 12(2).
Toribio et al., "New insights into the topology of the scanning ribosome during translation initiation: Lessons from viruses," Nucleic Acids Res, vol. 44, Issue 9, 2016, pp. 4368-4380.
Van Allen et al., "Genomic correlates of response to CTLA-4 blockade in metastatic melanoma.", Science, Oct. 9, 2015, pp. 207-211, vol. 350(6257), Epub Sep. 10, 2015.
Vaughan et al., "Human Antibodies with Sub-nanomolar Affinities Isolated from a large Non-immunized Phage Display Library.", Nature Biotechnology, 1996, pp. 309-314, vol. 14.
Ventoso, J. Virol., "Adaptive Changes in Alphavirus mRNA Translation Allowed Colonization of Vertebrate Hosts", 9484-9494, vol. 86, Sep. 2012.
Wang et al., "A packaging cell line for propagation of recombinant adenovirus vectors containing two lethal gene-region deletions.", Gene Ther., 1995, pp. 775-783, vol. 2.
Wu and Kabat, "An Analysis of the Sequences of the Variable Regions of Bence Jones Proteins and Myeloma Light Chains And Their Implications for Anti-body Complementarity*.", J Exp Med, 1970, pp. 211-250, vol. 132.
Yang et al., "Eradication of Established Tumors by a Fully Human Monoclonal Antibody to the Epidermal Growth Factor Receptor without Concomitant Chemotherapy.", Cancer Res, Mar. 15, 1999, DD. 1236-1243, vol. 59.
Yeh et al., "Efficient Dual Transcomplementation of Adenovirus E1 and E4 Regions from a 293-Derived Cell Line Expressing a Minimal E4 Functional Unit.", J. Viral., Jan. 1996, pp. 559-565, vol. 70(1).
Zhang J. et al., "Integrate-neo: a pipeline for personalized gene fusion neoantigen discovery," Bioinformatics, vol. 33, Issue 4, Feb. 2017, pp. 555-557.
Anassi et al., "Sipuleucel-T (Provenge) Injection, Pharmacy & Therapeutics," Apr. 2011, vol. 36, No. 4, pp. 197-202.
Gulley et al., Phase III Trial of Prostvac in Asymptomatic or Minimally Symptomatic Metastatic Castration-Resistant Prostate Cancer, Journal of Clinical Oncology, 2019, vol. 37, Issue 13, pp. 1051-1061.

* cited by examiner

PROSTATE NEOANTIGENS AND THEIR USES

CROSS REFERENCE TO RELATED APPLICATIONS

This application claims priority to U.S. Provisional Application No. 63/048,484, filed Jul. 6, 2020, the disclosure of which is hereby incorporated by reference in its entirety.

SEQUENCE LISTING

This application contains a Sequence Listing submitted via EFS-Web, the entire content of which is incorporated herein by reference in its entirety. The ASCII text file, created on 6 Jul. 2020, is named 103693.002549_SL.txt and is 589 kilobytes in size.

BACKGROUND

Prostate cancer is the most common non-cutaneous malignancy in men and the second leading cause of death in men from cancer in the western world. Prostate cancer results from the uncontrolled growth of abnormal cells in the prostate gland. Once a prostate cancer tumor develops, androgens such as testosterone promote prostate cancer growth. At its early stages, localized prostate cancer is often curable with local therapy including, for example, surgical removal of the prostate gland and radiotherapy. However, when local therapy fails to cure prostate cancer, as it does in up to a third of men, the disease progresses into incurable metastatic disease.

For many years, the established standard of care for men with malignant castration-resistant prostate cancer (mCRPC) was docetaxel chemotherapy. More recently, abiraterone acetate (ZYTIGA®) in combination with prednisone has been approved for treating metastatic castrate resistant prostate cancer. Androgen receptor (AR)-targeted agents, such as enzalutamide (XTANDI®) have also entered the market for treating metastatic castrate resistant prostate cancer. Platinum-based chemotherapy has been tested in a number of clinical studies in molecularly unselected prostate cancer patients with limited results and significant toxicities. However, there remains a subset of patients who either do not respond initially or become refractory (or resistant) to these treatments. No approved therapeutic options are available for such patients.

BRIEF SUMMARY

Provided herein is a self-replicating RNA molecule comprising an RNA encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446, 447, and fragments thereof.

Also disclosed is a self-replicating RNA molecule comprising a RNA corresponding to one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539, 540, and fragments thereof.

Also disclosed is a self-replicating RNA molecule wherein the self-replicating RNA molecule comprises an RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, 177, and fragments thereof.

The disclosure also provides a self-replicating RNA molecule comprising an RNA corresponding to one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24, 178, and fragments thereof.

The disclosure also provides a self-replicating RNA molecule comprising an RNA encoding a polypeptide of SEQ ID NOs: 541, 543, 550, 552, 554, 555, 556, 557, 558, 559, 623, or 624, 625 or 626.

Also disclosed is a self-replicating RNA molecule further comprising one or more of the following:

- a) one or more nonstructural genes nsP1, nsP2, nsP3, and nsP4;
- b) at least one of a DLP motif, a 5' UTR, a 3'UTR, and a Poly A;
- c) a subgenomic promoter; and
- d) a RNA encoding for one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 177, and fragments thereof; operably linked to the subgenomic promoter.

Also disclosed is a self-replicating RNA molecule further comprising one or more of the following:

a) one or more nonstructural genes nsP1, nsP2, nsP3, and nsP4;
b) at least one of a DLP motif, 5' UTR, a 3'UTR, and a Poly A;
c) a subgenomic promoter; and
d) a RNA encoding one or more polypeptides selected from the group consisting of SEQ ID NOs: 541, 543, 550, 552, 554, 555, 556, 557, 558, 559, 623, 624, 625, 626, and fragments thereof; operably linked to the subgenomic promoter.

The disclosure also provides a self-replicating RNA molecule encapsulated in, bound to, or adsorbed on a liposome, a lipoplex, a lipid nanoparticle, or combinations thereof. In some embodiments, the self-replicating RNA molecule is encapsulated in a lipid nanoparticle.

The disclosure also provides a method of immunizing and methods of treating or preventing prostate cancer in a subject, comprising administering to the subject in need thereof any of the disclosed self-replicating RNA molecules. In some embodiments, the methods comprise administering to the subject:

a first vaccine comprising a self-replicating RNA molecule comprising an RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; and a second vaccine comprising a polynucleotide encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; wherein the first polypeptide and the second polypeptide have distinct amino acid sequences.

BRIEF DESCRIPTION OF THE DRAWINGS

The summary, as well as the following detailed description, is further understood when read in conjunction with the appended drawings. For the purpose of illustrating the disclosed compositions and methods, there are shown in the drawings exemplary embodiments of the compositions and methods; however, the compositions and methods are not limited to the specific embodiments disclosed. In the drawings:

FIG. 9 panel B shows the schematic representation of an exemplary self-replicating RNA (srRNA) derived from alphavirus replicons, where viral structural genes are replaced by heterologous gene of interest under the transcriptional control of a subgenomic promoter (SGP). Conserved sequence elements (CSE) at the 5' and 3'-end act as promoters for minus-strand and positive-strand RNA transcription. After the srRNA is delivered into a cell, the non-structural polyprotein precursor (nsP1234) is translated from in vitro transcribed srRNA. nsP1234 is at early stages auto-proteolytically processed to the fragments nsP123 and nsP4, which transcribes negative-stranded copies of the srRNA. Later, nsP123 is completely processed to single proteins, which assemble to the (+) strand replicase to transcribe new positive-stranded genomic copies, as well as (+) stranded subgenomic transcripts that code for the gene of interest. Subgenomic RNA as well as new genomic RNA is capped and poly-adenylated. Inactive promoters are dotted arrows; active promoters are lined arrows (Beissert et al., Hum Gene Ther. 2017, 28(12): 1138-1146).

DETAILED DESCRIPTION

Figure 1:
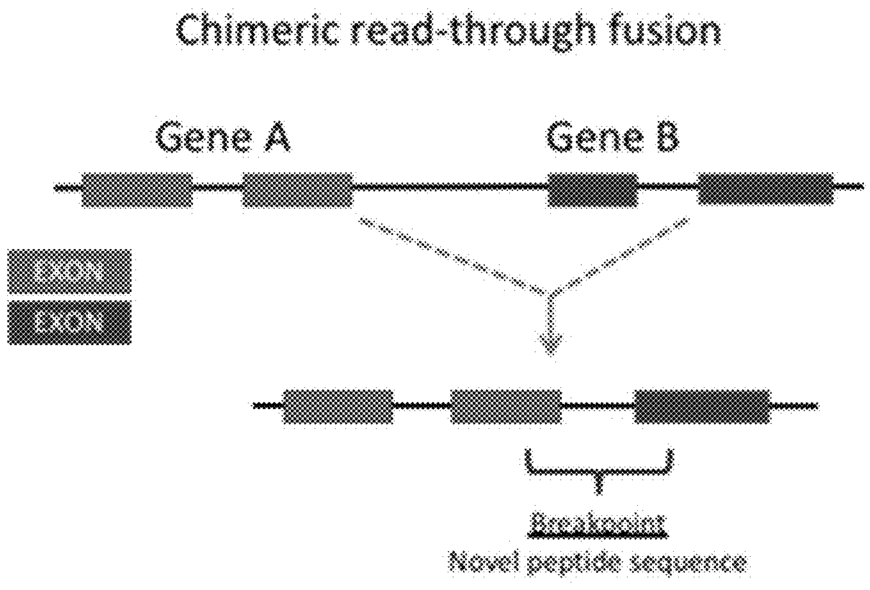
FIG. 1 depicts an exemplary chimeric read-through fusion between Gene A and Gene B. Neoantigenic peptide sequences arise at the breakpoint junction.

The disclosed compositions and methods may be understood more readily by reference to the following detailed description taken in connection with the accompanying figures, which form a part of this disclosure. It is to be understood that the disclosed compositions and methods are not limited to the specific compositions and methods described and/or shown herein, and that the terminology used herein is for the purpose of describing particular embodiments by way of example only and is not intended to be limiting of the claimed compositions and methods.

All publications, including but not limited to patents and patent applications, cited in this specification are herein incorporated by reference as though fully set forth.

Although any methods and materials similar or equivalent to those described herein may be used in the practice for testing of the present disclosure, exemplary materials and methods are described herein. In describing and claiming the present disclosure, the following terminology will be used.

Unless specifically stated otherwise, any description as to a possible mechanism or mode of action or reason for improvement is meant to be illustrative only, and the disclosed compositions and methods are not to be constrained by the correctness or incorrectness of any such suggested mechanism or mode of action or reason for improvement.

Throughout this text, the descriptions refer to composition and methods of using the compositions. Where the disclosure describes or claims a feature or embodiment associated with a composition, such a feature or embodiment is equally applicable to the methods of using the composition. Likewise, where the disclosure describes or claims a feature or embodiment associated with a method of using a composition, such a feature or embodiment is equally applicable to the composition.

It is to be appreciated that certain features of the disclosed compositions and methods which are, for clarity, described herein in the context of separate embodiments, may also be provided in combination in a single embodiment. Conversely, various features of the disclosed compositions and methods that are, for brevity, described in the context of a single embodiment, may also be provided separately or in any subcombination.

Various terms relating to aspects of the description are used throughout the specification and claims. Such terms are to be given their ordinary meaning in the art unless otherwise indicated. Other specifically defined terms are to be construed in a manner consistent with the definitions provided herein.

As used in this specification and the appended claims, the singular forms "a," "an," and "the" include plural referents unless the content clearly dictates otherwise. Thus, for example, reference to "a cell" includes a combination of two or more cells, and the like.

Embodiments described in terms of the phrase "comprising" (or its equivalents) also provide as embodiments those independently described in terms of "consisting of" and "consisting essentially of." Embodiments described in terms of the phrase "consisting essentially of" (or its equivalents) also provide as embodiments those independently described in terms of "consisting of."

As used in this specification and the appended claims, the phrase "and fragments thereof" when appended to a list includes fragments of one or more members of the associated list. The list may comprise a Markush group so that, as an example, the phrase "the group consisting of peptides A, B, and C, and fragments thereof" specifies or recites a Markush group including A, B, C, fragments of A, fragments of B, and/or fragments of C.

"Isolated" refers to a homogenous population of molecules (such as synthetic polynucleotides or polypeptides) which have been substantially separated and/or purified away from other components of the system the molecules are produced in, such as a recombinant cell, as well as a protein that has been subjected to at least one purification or isolation step. "Isolated" refers to a molecule that is substantially free of other cellular material and/or chemicals and encompasses molecules that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

"Immunogenic fragment" refers to a polypeptide that is recognized by cytotoxic T lymphocytes, helper T lymphocytes or B cells when the fragment is in complex with MHC class I or MHC class II molecules.

"In-frame" refers to the reading frame of codons in a first polynucleotide being the same as the reading frame of codons in a second polynucleotide which are joined together to form a polynucleotide. In-frame polynucleotide encodes a polypeptide encoded by both the first polynucleotide and the second polynucleotide.

"Immunogenic" refers to a polypeptide that comprises one or more immunogenic fragments.

"Heterologous" refers to two or more polynucleotides or two or more polypeptides that are not found in the same relationship to each other in nature.

"Heterologous polynucleotide" refers to a non-naturally occurring polynucleotide that encodes two or more neoantigens as described herein.

"Heterologous polypeptide" refers to a non-naturally occurring polypeptide comprising two or more neoantigen polypeptides as described herein.

"Non-naturally occurring" refers to a molecule that does not exist in nature.

"Neoantigen" refers to a polypeptide that is present in prostate tumor tissue that has at least one alteration that makes it distinct from the corresponding wild-type polypeptide present in non-malignant tissue, e.g., via mutation in a tumor cell or post-translational modification specific to a tumor cell. A mutation can include a frameshift or nonframeshift insertion or deletion, missense or nonsense substitution, splice site alteration, aberrant splice variants, genomic rearrangement or gene fusion, or any genomic or expression alteration giving rise to the neoantigen.

"Recombinant" refers to polynucleotides, polypeptides, vectors, viruses and other macromolecules that are prepared, expressed, created or isolated by recombinant means.

"Vaccine" refers to a composition that comprises one or more immunogenic polypeptides, immunogenic polynucleotides, or fragments, or any combination thereof intentionally administered to induce acquired immunity in the recipient (e.g. subject).

"Treat," "treating," or "treatment" of a disease or disorder such as cancer refers to accomplishing one or more of the following: reducing the severity and/or duration of the disorder, inhibiting worsening of symptoms characteristic of the disorder being treated, limiting or preventing recurrence of the disorder in subjects that have previously had the disorder, or limiting or preventing recurrence of symptoms in subjects that were previously symptomatic for the disorder.

"Prevent," "preventing," "prevention," or "prophylaxis" of a disease or disorder means preventing that a disorder occurs in subject.

"Therapeutically effective amount" refers to an amount effective, at doses and for periods of time necessary, to achieve a desired therapeutic result. A therapeutically effective amount may vary depending on factors such as the disease state, age, sex, and weight of the individual, and the ability of a therapeutic or a combination of therapeutics to elicit a desired response in the individual. Exemplary indicators of an effective therapeutic or combination of therapeutics that include, for example, improved well-being of the patient.

"Relapsed" refers to the return of a disease or the signs and symptoms of a disease after a period of improvement after prior treatment with a therapeutic.

"Refractory" refers to a disease that does not respond to a treatment. A refractory disease can be resistant to a treatment before or at the beginning of the treatment, or a refractory disease can become resistant during a treatment.

"Replicon" refers to a viral nucleic acid that is capable of directing the generation of copies of itself and includes RNA as well as DNA. For example, double-stranded DNA versions of arterivirus genomes can be used to generate a single-stranded RNA transcript that constitutes an arterivirus replicon. Generally, a viral replicon contains the complete genome of the virus.

The term "RNA replicon" (or "self-replicating RNA," "self-replicating RNA molecule," or "srRNA") refer to RNA which contains all of the genetic information required for directing its own amplification or self-replicating within a permissive cell. To direct its own replication, the RNA molecule 1) encodes polymerase, replicase, or other proteins which may interact with viral or host cell-derived proteins, nucleic acids or ribonucleoproteins to catalyze the RNA amplification process; and 2) contain cis-acting RNA sequences required for replication and transcription of the replicon-encoded RNA. Self-replicating RNA is typically derived from the genomes of positive strand RNA viruses and can be used as basis of introducing foreign sequences to host cells by replacing viral sequences encoding structural or non-structural genes or inserting the foreign sequences 5' or 3' of the sequences encoding the structural or non-structural genes. Foreign sequences may also be introduced into the subgenomic regions of alphaviruses. Self-replicating RNA may be packaged into recombinant virus particles, such as recombinant alphavirus particles or alternatively delivered to the host using lipid nanoparticles (LNP). Self-replicating RNA may be at least 1 kb or at least 2 kb or at least 3 kb or at least 4 kb or at least 5 kb or at least 6 kb or at least 7 kb or at least 8 kb or at least 10 kb or at least 12 kb or at least 15 kb or at least 17 kb or at least 19 kb or at least 20 kb in size, or can be 100 bp-8 kb or 500 bp-8 kb or 500 bp-7 kb or 1-7 kb or 1-8 kb or 2-15 kb or 2-20 kb or 5-15 kb or 5-20 kb or 7-15 kb or 7-18 kb or 7-20 kb in size. Self-replicating RNAs are described, for example, in Int'l Pub. Nos. WO2017/180770, WO2018/075235, WO2019143949A2.

"Subgenomic RNA" refers to an RNA molecule of a length or size which is smaller than the genomic RNA from which it was derived. The viral subgenomic RNA can be transcribed from an internal promoter, whose sequences reside within the genomic RNA or its complement. Transcription of a subgenomic RNA can be mediated by viral-encoded polymerase(s) associated with host cell-encoded proteins, ribonucleoprotein(s), or a combination thereof. Numerous RNA viruses generate subgenomic mRNAs (sgRNAs) for expression of their 3'-proximal genes.

"Sub-genomic replicon" refers to a viral nucleic acid that contains something less than the full complement of genes and other features of the viral genome, yet is still capable of directing the generation of copies of itself. For example, the sub-genomic replicons of arterivirus may contain most of the genes for the non-structural proteins of the virus, but are missing most of the genes coding for the structural proteins. Sub-genomic replicons are capable of directing the expression of all of the viral genes necessary for the replication of the viral sub-genome (replication of the sub-genomic replicon), without the production of viral particles.

The viral subgenomic RNA can be transcribed from an internal promoter, whose sequences reside within the genomic RNA or its complement. Transcription of a subgenomic RNA can be mediated by viral-encoded polymerase(s) associated with host cell-encoded proteins, ribonucleoprotein(s), or a combination thereof.

"RNA corresponding to" refers to an RNA transcript generated from the DNA encoding the RNA or the RNA complement of a cDNA.

As used herein, a "downstream loop" or "DLP motif" refers to a polynucleotide sequence comprising at least one RNA stem-loop, which when placed downstream of a start codon of an open reading frame (ORF), provides increased translation the ORF compared to an otherwise identical construct without the DLP motif.

"Subject" includes any human or nonhuman animal. "Nonhuman animal" includes all vertebrates, e.g., mammals and non-mammals, such as nonhuman primates, sheep, dogs, cats, horses, cows, chickens, amphibians, reptiles, etc. The terms "subject" and "patient" can be used interchangeably herein.

"In combination with" means that two or more therapeutic agents are administered to a subject together in a mixture, concurrently as single agents or sequentially as single agents in any order.

"Enhance" or "induce" when in reference to an immune response refers to increasing the scale and/or efficiency of an immune response or extending the duration of the immune response. The terms are used interchangeably with "augment."

"Immune response" refers to any response to an immunogenic polypeptide or polynucleotide or fragment by the immune system of a vertebrate subject. Exemplary immune responses include local and systemic cellular as well as humoral immunity, such as cytotoxic T lymphocyte (CTL) responses, including antigen-specific induction of $CD8^+$ CTLs, helper T-cell responses including T-cell proliferative responses and cytokine release, and B-cell responses including antibody response.

"Variant," "mutant," or "altered" refers to a polypeptide or a polynucleotide that differs from a reference polypeptide or a reference polynucleotide by one or more modifications, for example one or more substitutions, insertions or deletions.

"About" means within an acceptable error range for the particular value as determined by one of skill in the art, which will depend in part on how the value is measured or determined, i.e., the limitations of the measurement system. Unless explicitly stated otherwise within the Examples or elsewhere in the Specification in the context of a particular assay, result or embodiment, "about" means within one standard deviation per the practice in the art, or a range of up to 5%, whichever is larger.

"Prime-boost" or "prime-boost regimen" refers to a method of treating a subject involving priming a T-cell response with a first vaccine followed by boosting the immune response with a second vaccine. The first vaccine and the second vaccine are typically distinct. These prime-boost immunizations elicit immune responses of greater height and breadth than can be achieved by priming and boosting with the same vaccine. The priming step initiates memory cells and the boost step expands the memory response. Boosting can occur once or multiple times.

Cancer cells produce neoantigens that result from genomic alterations and aberrant transcriptional programs. Neoantigen burden in patients has been associated with response to immunotherapy (Snyder et al., N Engl J Med. 2014 Dec. 4; 371(23):2189-2199. doi: 10.1056/NEJMoa1406498. Epub 2014 Nov. 19; Le et al., N Engl J Med.

2015 Jun. 25; 372(26):2509-20. doi: 10.1056/NEJMoa1500596. Epub 2015 May 30; Rizvi et al., Science. 2015 Apr. 3; 348(6230): 124-8. doi: 10.1126/science.aaa1348. Epub 2015 Mar. 12; Van Allen et al, Science. 2015 Oct. 9; 350(6257):207-211. doi: 10.1126/science.aad0095. Epub 2015 Sep. 10). The disclosure is based, at least in part, on the identification of prostate neoantigens that are common in prostate cancer patients and hence can be utilized to develop a therapy amenable to treatment of a spectrum of prostate cancer patients.

The disclosure provides self-replicating RNA molecules comprising RNA encoding prostate neoantigens, vectors, host cells, vaccines comprising the neoantigens or polynucleotides encoding the neoantigens, and methods of making and using them. The disclosure also provides vaccines comprising the prostate neoantigens of the disclosure that are prevalent in a population of prostate cancer patients, thereby providing a pan-vaccine that may be useful to treating a broad population of patients having prostate cancer of various stages, such as localized or metastasized prostate cancer.

Self-Replicating RNA Molecules

Self-replicating RNA molecules contain all of the genetic information required for directing their own amplification or self-replication within a permissive cell. To direct their own replication, self-replicating RNA molecules encode polymerase, replicase, or other proteins which may interact with viral or host cell-derived proteins, nucleic acids, or ribonucleoproteins to catalyze the RNA amplification process; and contain cis-acting RNA sequences required for replication and transcription of the replicon-encoded RNA. Thus, RNA replication leads to the production of multiple daughter RNAs. These daughter RNAs, as well as collinear subgenomic transcripts, can be translated to provide in situ expression of a gene of interest, or can be transcribed to provide further transcripts with the same sense as the delivered RNA which are translated to provide in situ expression of the gene of interest. The overall results of this sequence of transcriptions is a huge amplification in the number of the introduced replicon RNAs and so the encoded gene of interest becomes a major polypeptide product of the cells.

Figure 9:
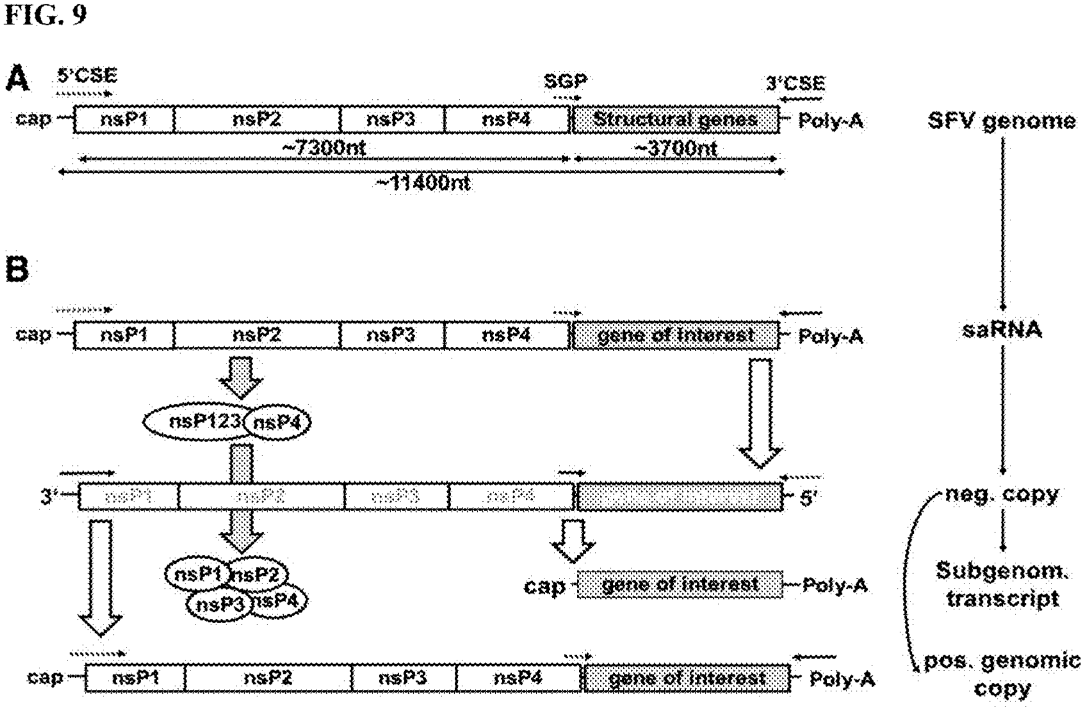
FIG. 9 panel A shows the schematic representation of the alphavirus genome of the Semliki Forest virus, a positive-sensed, single-stranded RNA that encodes the non-structural polyproteins (nsP1-nsP4; replicase) at the 5'-end and the structural genes (capsid and glycoproteins) at the 3'-end.

There are two open reading frames (ORFs) in the genome of alphaviruses, non-structural (ns) and structural genes. The ns ORF encodes proteins (nsP1-nsP4) necessary for transcription and replication of viral RNA and are produced as a polyprotein and are the virus replication machinery. The structural ORF encodes three structural proteins: the core nucleocapsid protein C, and the envelope proteins P62 and E1 that associate as a heterodimer. The viral membrane-anchored surface glycoproteins are responsible for receptor recognition and entry into target cells through membrane fusion. The four ns protein genes are encoded by genes in the 5' two-thirds of the genome, while the three structural proteins are translated from a subgenomic mRNA colinear with the 3' one-third of the genome. An exemplary depiction of an alphavirus genome is shown in FIG. 9.

Self-replicating RNA molecules can be used as basis of introducing foreign sequences to host cells by replacing viral sequences encoding structural genes or inserting the foreign sequences 5' or 3' of the sequences encoding the structural genes. They can be engineered to replace the viral structural genes downstream of the replicase, which are under control of a subgenomic promoter, by genes of interest (GOI), e.g. prostate neoantigens. Upon transfection, the replicase which is translated immediately, interacts with the 5' and 3' termini of the genomic RNA, and synthesizes complementary genomic RNA copies. Those act as templates for the synthesis of novel positive-stranded, capped, and poly-adenylated genomic copies, and subgenomic transcripts (FIG. 9). Amplification eventually leads to very high RNA copy numbers of up to $2\times10^5$ copies per cell. The result is a uniform and/or enhanced expression of a GOI (e.g. prostate neoantigens) that can affect vaccine efficacy or therapeutic impact of a treatment. Vaccines based on self-replicating RNA can be dosed at very low levels due to the very high copies of RNA generated.

Since much lower amounts of replicon RNA compared to conventional viral vector suffice to achieve effective gene transfer and protective vaccination (Beissert et al., Hum Gene Ther. 2017, 28(12): 1138-1146), one of the significant values of the compositions and methods disclosed herein is that vaccine efficacy can be increased in individuals that are in a chronic or acute state of immune activation. Causes of chronic or acute immune activation could be found in individuals suffering from a subclinical or clinical infection or individuals undergoing medical treatments for cancer or other maladies (e.g., diabetes, malnutrition, high blood pressure, heart disease, Crohn's disease, muscular scleroses, etc.).

The self-replicating RNA molecules contain all of the genetic information required for directing its own amplification or self-replication within a permissive cell.

The self-replicating RNA molecules can be used as a basis of introducing foreign sequences (e.g. prostate neoantigens) to host cells by replacing viral sequences encoding structural genes.

Provided herein are self-replicating RNA molecules comprising a polynucleotide encoding one or more prostate neoantigen polypeptides. The self-replicating RNA molecules can comprise an RNA encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 and 447, and fragments thereof.

The self-replicating RNA molecules can comprise an RNA corresponding to one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539 and 540, and fragments thereof.

The self-replicating RNA molecules can comprise an RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof.

The self-replicating RNA molecules can comprise an RNA encoding one or more polypeptides selected from the group consisting of AS18 comprising the amino acid sequence (SEQ ID NO: 275)
WKFEMSYTVGGPPPHVHARPRHWKTDR;

P87 comprising the amino acid sequence (SEQ ID NO: 381)
YEAGMTLGGKILFFLFLLLPLSPFSLIF;

AS55 comprising the amino acid sequence (SEQ ID NO: 333)
DGHSYTSKVNCLLLQDGFHGCVSITGAAGRRNLSIFLFLMLCKLEFHAC;

AS57 comprising the amino acid sequence (SEQ ID NO: 337)
TGGKSTCSAPGPQSLPSTPFSTYPQWVILITEL;

AS15 comprising the amino acid sequence (SEQ ID NO: 269)
VLRFLDLKVRYLHS;

AS7 comprising the amino acid sequence (SEQ ID NO: 253)
DYWAQKEKGSSSFLRPSC;

AS43 comprising the amino acid sequence (SEQ ID NO: 309)
VPFRELKNVSVLEGLRQGRLGGPCSCHCPRPSQARLTPVDVAGPFLCLGD

PGLFPPVKSSI;

AS51 comprising the amino acid sequence (SEQ ID NO: 325)
GMECTLGQVGAPSPRREEDGWRGGHSRFKADVPAPQGPCWGGQPGSAPSS

APPEQSLLD;

AS16 comprising the amino acid sequence (SEQ ID NO: 271)
GNTTLQQLGEASQAPSGSLIPLRLPLLWEVRG;

AS41 comprising the amino acid sequence (SEQ ID NO: 305)
EAFQRAAGEGGPGRGGARRGARVLQSPFCRAGAGEWLGHQSLR;

AS6 comprising the amino acid sequence (SEQ ID NO: 251)
DYWAQKEKISIPRTHLC;

AS3 comprising the amino acid sequence (SEQ ID NO: 245)
VAMMVPDRQVHYDFGL;

-continued

AS11 comprising the amino acid sequence (SEQ ID NO: 261)
VPFRELKNQRTAQGAPGIHHAASPVAANLCDPARHAQHTRIPCGAGQVRA

GRGPEAGGGVLQPQRPAPEKPGCPCRRGQPRLHTVKMWRA;

AS13 comprising the amino acid sequence (SEQ ID NO: 265)
KRSFAVTERII;

AS47 comprising the amino acid sequence (SEQ ID NO: 317)
FKKFDGPCGERGGGRTARALWARGDSVLTPALDPQTPVRAPSLTRAAAA

V;

AS8 comprising the amino acid sequence (SEQ ID NO: 255)
LVLGVLSGHSGSRL;

AS19 comprising the amino acid sequence (SEQ ID NO: 277)
QWQHYHRSGEAAGTPLWRPTRN;

AS37 comprising the amino acid sequence (SEQ ID NO: 297)
CHLFLQPQVGTPPPHTASARAPSGPPHPHESCPAGRRPARAAQTCARRQH

GLPGCEEAGTARVPSLHLHLHQAALGAGRGRGWGEACAQVPPSRG;

AS23 comprising the amino acid sequence (SEQ ID NO: 285)
KIQNKNCPD;

MS1 comprising the amino acid sequence (SEQ ID NO: 437)
HYKLIQQPISLFSITDRLHKTFSQLPSVHLCSITFQWGHPPIFCSTNDIC

VTANFCISVTFLKPCFLLHEASASQ;

MS3 comprising the amino acid sequence (SEQ ID NO: 439)
RTALTHNQDFSIYRLCCKRGSLCHASQARSPAFPKPVRPLPAPITRITPQ

LGGQSDSSQPLLTTGRPQGWQDQALRHTQQASPASCATITIPIHSAALGD

HSGDPGPAWDTCPPLPLTTLIPRAPPPYGDSTARSWPSRCGPLG;

MS6 comprising the amino acid sequence (SEQ ID NO: 442)
YAYKDFLWCFPFSLVFLQEIQICCHVSCLCCICCSTRICLGCLLELFLSR

ALRALHVLWNGFQLHCQ;

MS8 comprising the amino acid sequence (SEQ ID NO: 444)
TMPAILKLQKNCLLSL;
and

P82 comprising the amino acid sequence (SEQ ID NO: 379)
YEAGMTLGEKFRVGNCKHLKMTRP,
and fragments thereof.

In some embodiments, the self-replicating RNA molecules can comprise an RNA encoding one or more polypeptides selected from the group consisting of P16 comprising the amino acid sequence (SEQ ID NO: 343)
GVPGDSTRRAVRRMNTF;

FUS1 comprising the amino acid sequence (SEQ ID NO: 211)
CGASACDVSLIAMDSA;

-continued

P22 comprising the amino acid sequence
(SEQ ID NO: 349)
SLYHREKQLIAMDSAI;

FUS2 comprising the amino acid sequence
(SEQ ID NO: 213)
TEYNQKLQVNQFSESK;

FUS3 comprising the amino acid sequence
(SEQ ID NO: 215)
TEISCCTLSSEENEYLPRPEWQLQ;

FUS6 comprising the amino acid sequence
(SEQ ID NO: 221)
CEERGAAGSLISCE;

FUSS comprising the amino acid sequence
(SEQ ID NO: 219)
NSKMALNSEALSVVSE;

FUS8 comprising the amino acid sequence
(SEQ ID NO: 225)
WGMELAASRRFSWDHHSAGGPPRVPSVRSGAAQVQPKDPLPLRTLAGCLA

RTAHLRPGAESLPQPQLHCT;

FUS15 comprising the amino acid sequence
(SEQ ID NO: 345)
HVVGYGHLDTSGSSSSSSWP;

P35 comprising the amino acid sequence
(SEQ ID NO: 353)
NSKMALNSLNSIDDAQLTRIAPPRSHCCFWEVNAP;

FUS19 comprising the amino acid sequence
(SEQ ID NO: 235)
KMHFSLKEHPPPPCPP;
and

FUS7 comprising the amino acid sequence
(SEQ ID NO: 223)
LWFQSSELSPTGAPWPSRRPTWRGTTVSPRTATSSARTCCGTKWPSSQEA ALGLGSGLLRFSCGTAAIR,
and fragments thereof The self-replicating RNA molecules can comprise an RNA encoding one or more polypeptides selected from the group consisting of P16 comprising the amino acid sequence
(SEQ ID NO: 343)
GVPGDSTRRAVRRMNTF;

FUS1 comprising the amino acid sequence
(SEQ ID NO: 211)
CGASACDVSLIAMDSA;

P22 comprising the amino acid sequence
(SEQ ID NO: 349)
SLYHREKQLIAMDSAI;

FUS2 comprising the amino acid sequence
(SEQ ID NO: 213)
TEYNQKLQVNQFSESK;

FUS3 comprising the amino acid sequence
(SEQ ID NO: 215)
TEISCCTLSSEENEYLPRPEWQLQ;

FUS6 comprising the amino acid sequence
(SEQ ID NO: 221)
CEERGAAGSLISCE;

FUS5 comprising the amino acid sequence
(SEQ ID NO: 219)
NSKMALNSEALSVVSE;

-continued

FUS8 comprising the amino acid sequence
(SEQ ID NO: 225)
WGMELAASRRFSWDHHSAGGPPRVPSVRSGAAQVQPKDPLPLRTLAGCLA

RTAHLRPGAESLPQPQLHCT;

FUS15 comprising the amino acid sequence
(SEQ ID NO: 345)
HVVGYGHLDTSGSSSSSSWP;

P35 comprising the amino acid sequence
(SEQ ID NO: 353)
NSKMALNSLNSIDDAQLTRIAPPRSHCCFWEVNAP;

FUS19 comprising the amino acid sequence
(SEQ ID NO: 235)
KMHFSLKEHPPPPCPP;
and

FUS7 comprising the amino acid sequence
(SEQ ID NO: 223)
LWFQSSELSPTGAPWPSRRPTWRGTTVSPRTATSSARTCCGTKWPSSQEA ALGLGSGLLRFSCGTAAIR,
and fragments thereof In some embodiments, the self-replicating RNA molecule comprises an RNA encoding one or more polypeptides selected from the group consisting of AS18 comprising the amino acid sequence
(SEQ ID NO: 275)
WKFEMSYTVGGPPPHVHARPRHWKTDR;

P87 comprising the amino acid sequence
(SEQ ID NO: 381)
YEAGMTLGGKILFFLFLLLPLSPFSLIF;

AS55 comprising the amino acid sequence
(SEQ ID NO: 333)
DGHSYTSKVNCLLLQDGFHGCVSITGAAGRRNLSIFLFLMLCKLEFHAC;

AS57 comprising the amino acid sequence
(SEQ ID NO: 337)
TGGKSTCSAPGPQSLPSTPFSTYPQWVILITEL;

AS15 comprising the amino acid sequence
(SEQ ID NO: 269)
VLRFLDLKVRYLHS;

AS7 comprising the amino acid sequence
(SEQ ID NO: 253)
DYWAQKEKGSSSFLRPSC;

AS43 comprising the amino acid sequence
(SEQ ID NO: 309)
VPFRELKNVSVLEGLRQGRLGGPCSCHCPRPSQARLTPVDVAGPFLCLGD

PGLFPPVKSSI;

AS51 comprising the amino acid sequence
(SEQ ID NO: 325)
GMECTLGQVGAPSPRREEDGWRGGHSRFKADVPAPQGPCWGGQPGSAPSS

APPEQSLLD;

AS16 comprising the amino acid sequence
(SEQ ID NO: 271)
GNTTLQQLGEASQAPSGSLIPLRLPLLWEVRG;

AS41 comprising the amino acid sequence
(SEQ ID NO: 305)
EAFQRAAGEGGPGRGGARRGARVLQSPFCRAGAGEWLGHQSLR;

AS6 comprising the amino acid sequence
(SEQ ID NO: 251)
DYWAQKEKISIPRTHLC;

-continued

AS3 comprising the amino acid sequence
(SEQ ID NO: 245)
VAMMVPDRQVHYDFGL;

AS11 comprising the amino acid sequence
(SEQ ID NO: 261)
VPFRELKNQRTAQGAPGIHHAASPVAANLCDPARHAQHTRIPCGAGQVRA

GRGPEAGGGVLQPQRPAPEKPGCPCRRGQPRLHTVKMWRA;

AS13 comprising the amino acid sequence
(SEQ ID NO: 265)
KRSFAVTERII;

S47 comprising the amino acid sequence
(SEQ ID NO: 317)
FKKFDGPCGERGGGRTARALWARGDSVLTPALDPQTPVRAPSLTRAAAA

V;

AS8 comprising the amino acid sequence
(SEQ ID NO: 255)
LVLGVLSGHSGSRL;

AS19 comprising the amino acid sequence
(SEQ ID NO: 277)
QWQHYHRSGEAAGTPLWRPTRN;

AS37 comprising the amino acid sequence
(SEQ ID NO: 297)
CHLFLQPQVGTPPPHTASARAPSGPPHPHESCPAGRRPARAAQTCARRQH

GLPGCEEAGTARVPSLHLHLHQAALGAGRGRGWGEACAQVPPSRG;

AS23 comprising the amino acid sequence
(SEQ ID NO: 285)
KIQNKNCPD;

MS1 comprising the amino acid sequence
(SEQ ID NO: 437)
HYKLIQQPISLFSITDRLHKTFSQLPSVHLCSITFQWGHPPIFCSTNDIC

VTANFCISVTFLKPCFLLHEASASQ;

MS3 comprising the amino acid sequence
(SEQ ID NO: 439)
RTALTHNQDFSIYRLCCKRGSLCHASQARSPAFPKPVRPLPAPITRITPQ

LGGQSDSSQPLLTTGRPQGWQDQALRHTQQASPASCATITIPIHSAALGD

HSGDPGPAWDTCPPLPLTTLIPRAPPPYGDSTARSWPSRCGPLG;

MS6 comprising the amino acid sequence
(SEQ ID NO: 442)
YAYKDFLWCFPFSLVFLQEIQICCHVSCLCCICCSTRICLGCLLELFLSR

ALRALHVLWNGFQLHCQ;

MS8 comprising the amino acid sequence
(SEQ ID NO: 444)
TMPAILKLQKNCLLSL;
and

P82 comprising the amino acid sequence
(SEQ ID NO: 379)
YEAGMTLGEKFRVGNCKHLKMTRP,
and fragments thereof In some embodiments, the polypeptide comprises one or more polypeptides selected from the group consisting of M84 comprising the amino acid sequence
(SEQ ID NO: 167)
IARELHQFAFDLLIKSH;

M86 comprising the amino acid sequence
(SEQ ID NO: 171)
QPDSFAALHSSLNELGE;

-continued

M10 comprising the amino acid sequence
(SEQ ID NO: 19)
FVQGKDWGLKKFIRRDF;

M12 comprising the amino acid sequence
(SEQ ID NO: 23)
FVQGKDWGVKKFIRRDF;
and

FR1 comprising the amino acid sequence
(SEQ ID NO: 177)
QNLQNGGGSRSSATLPGRRRRRWLRRRRQPISVAPAGPPRRPNQKPNPPG GARCVIMRPTWPGTSAFT,
and fragments thereof The self-replicating RNA molecules can comprise an RNA corresponding to one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24 and 178, and fragments thereof. The self-replicating RNA molecule can comprise an RNA corresponding to one or more polynucleotides selected from the group consisting of:

the polynucleotide sequence of
(SEQ ID NO: 276)
TGGAAATTCGAGATGAGCTACACGGTGGGTGGCCCGCCTCCCCATGTTCA TGCTAGACCCAGGCATTGGAAAACTGATAGA (encoding AS18);

the polynucleotide sequence of
(SEQ ID NO: 382)
TATGAAGCAGGGATGACTCTGGGAGGTAAGATACTTTTCTTTCTCTTCCT CCTCCTTCCTCTCTCCCCCTTCTCCCTCATTTTC (encoding P87);

the polynucleotide sequence of
(SEQ ID NO: 334)
GATGGCCACTCCTACACATCCAAGGTGAATTGTTTACTCCTTCAAGATGG

GTTCCATGGCTGTGTGAGCATCACCGGGGCAGCTGGAAGAAGAAACCTGA

GCATCTTCCTGTTCTTGATGCTGTGCAAATTGGAGTTCCATGCTTGT
(encoding AS55);

the polynucleotide sequence of
(SEQ ID NO: 338)
ACAGGGGGCAAAAGCACCTGCTCGGCTCCTGGCCCTCAGTCTCTCCCCTC CACTCCATTCTCCACCTACCCACAGTGGGTCATTCTGATCACCGAACTG
(encoding AS57);

the polynucleotide sequence of
(SEQ ID NO: 270)
GTGCTGCGCTTTCTGGACTTAAAGGTGAGATACCTGCACTCT
(encoding AS15);

the polynucleotide sequence of
(SEQ ID NO: 254)
GACTACTGGGCTCAAAAGGAGAAGGGATCATCTTCATTCCTGCGACCATC CTGT (encoding AS7);

the polynucleotide sequence of
(SEQ ID NO: 310)
GTGCCCTTCCGGGAGCTCAAGAACGTGAGTGTCCTGGAGGGGCTCCGTCA

AGGCCGGCTTGGGGGTCCCTGTTCATGTCACTGCCCAAGACCTTCCCAGG

CCAGGCTCACGCCAGTGGATGTGGCAGGTCCCTTCTTGTGTCTGGGGGAT

CCTGGGCTGTTCCCCCCAGTCAAGAGCAGTATC (encoding AS43);

-continued the polynucleotide sequence of
(SEQ ID NO: 326)
GGCATGGAGTGCACCCTGGGGCAGGTGGGTGCCCCGTCCCCTCGGAGGGA
GGAGGACGGTTGGCGTGGGGGCCACAGCCGATTCAAGGCTGATGTACCAG
CACCGCAGGGACCCTGCTGGGGTGGCCAACCTGGCTCTGCCCCCTCCTCA
GCTCCTCCTGAACAGTCATTATTAGAT (encoding AS51);

the polynucleotide sequence of
((SEQ ID NO: 272)
GGCAACACCACCCTCCAGCAGCTGGGTGAGGCCTCCCAGGCGCCCTCAGG
CTCCCTCATCCCTCTGAGGCTGCCTCTGCTCTGGGAAGTGAGGGGC
(encoding AS16);

the polynucleotide sequence of
(SEQ ID NO: 306)
GAGGCCTTCCAGAGGGCCGCTGGTGAGGGCGGCCCGGGCCGCGGTGGGGC
ACGGCGCGGTGCCAGGGTGTTGCAGAGCCCCTTTTGCAGGGCAGGAGCTG
GGGAGTGGTTAGGACATCAGTCCCTCAGG (encoding AS41);

the polynucleotide sequence of
(SEQ ID NO: 252)
GACTACTGGGCTCAAAAGGAGAAGATCAGCATCCCCAGAACACACCTGTG
T (encoding AS6);

the polynucleotide sequence of
(SEQ ID NO: 246)
GTTGCTATGATGGTTCCTGATAGACAGGTTCATTATGACTTTGGATTG
(encoding AS3);

the polynucleotide sequence of
(SEQ ID NO: 262)
GTGCCCTTCCGGGAGCTCAAGAACCAGAGAACAGCACAAGGGGCTCCTGG
GATCCACCACGCGGCTTCCCCCGTTGCTGCCAACCTCTGCGACCCGGCGA
GACACGCACAGCACACACGCATCCCCTGCGGCGCTGGCCAAGTGCGTGCT
GGCCGAGGTCCCGAAGCAGGTGGTGGAGTACTACAGCCACAGAGGCCTGC
CCCCGAGAAGCCTGGGTGTCCCTGCCGGAGAGGCCAGCCCAGGCTGCACA
CCGTGAAGATGTGGAGGGCG (encoding AS11);

the polynucleotide sequence of
(SEQ ID NO: 266)
AAGAGAAGTTTTGCTGTCACGGAGAGGATCATC (encoding AS13);

the polynucleotide sequence of
(SEQ ID NO: 318)
TTCAAGAAGTTCGACGGCCCTTGTGGTGAGCGCGGCGGCGGGCGCACGGC
TCGAGCTCTGTGGGCGCGCGGCGACAGCGTCCTGACTCCTGCCCTCGACC
CCCAGACCCCTGTCAGGGCGCCCTCCCTGACCCGAGCCGCAGCTGCCGTG
(encoding AS47);

the polynucleotide sequence of
(SEQ ID NO: 256)
CTTGTACTTGGTGTATTGAGCGGGCACAGTGGCTCACGCCTA
(encoding AS8);

the polynucleotide sequence of
(SEQ ID NO: 278)
CAGTGGCAGCACTACCACCGGTCAGGTGAGGCCGCAGGGACTCCCCTCTG
GAGACCCACAAGAAAC (encoding AS19);

the polynucleotide sequence of
(SEQ ID NO: 298)
TGCCACCTCTTCCTGCAGCCCCAGGTTGGCACCCCCCCCCCCCACACTGC
CAGTGCTCGAGCCCCCAGTGGTCCACCCCACCCTCATGAAAGTTGCCCTG
CAGGGCGAAGACCTGCGAGAGCTGCGCAGACATGTGCACGCCGACAGCAC
GGACTTCCTGGCTGTGAAGAGGCTGGTACAGCGCGTGTTCCCAGCCTGCA
CCTGCACCTGCACCAGGCCGCCCTCGGAGCAGGAAGGGGCCGTGGGTGGG
GAGAGGCCTGTGCCCAAGTACCCCCCTCAAGAGGC
(encoding AS37);

the polynucleotide sequence of
(SEQ ID NO: 286)
AAAATTCAGAATAAAAATTGTCCAGAC (encoding AS23);

the polynucleotide sequence of
(SEQ ID NO: 448)
CACTACAAATTAATTCAACAACCCATATCCCTCTTCTCCATCACTGATAG
GCTCCATAAGACGTTCAGTCAGCTGCCCTCGGTCCATCTCTGCTCAATCA
CCTTCCAGTGGGGACACCCGCCCATTTTCTGCTCAACAAATGATATCTGT
GTCACGGCCAACTTCTGCATCTCGGTCACATTCCTTAAACCGTGCTTCCT
CCTACATGAGGCATCTGCCTCACAG (encoding MS1);

the polynucleotide sequence of
(SEQ ID NO: 450)
AGGACCGCCCTGACACACAATCAGGACTTCTCTATCTACAGGCTCTGTTG
CAAGAGGGGGTCCCTCTGCCACGCTTCCCAGGCCAGATCCCCGGCTTTCC
CGAAGCCGGTCAGACCTCTTCCTGCCCCCATCACCAGAATCACCCCCCAA
CTGGGGGGACAATCTGACTCGAGTCAACCCCTTCTCACTACGGGAAGACC
TCAGGGGTGGCAAGATCAAGCTCTTAGACACACCCAGCAAGCCAGTCCTG
CCTCTTGTGCCACCATCACCATTCCCATCCACTCAGCTGCCCTTGGTGAC
CACTCCGGAGACCCTGGTCCAGCCTGGGACACCTGCCCGCCGCTGCCGCT
CACTACCCTCATCCCCCGAGCTCCCCCGCCGTATGGAGACAGCACTGCCA
GGTCCTGGCCCTCCCGCTGTGGCCCCTCGGC (encoding MS3);

the polynucleotide sequence of
(SEQ ID NO: 453)
TATGCTTACAAGGACTTTCTCTGGTGTTTTCCTTTTTCTTTAGTTTTTCT
CCAAGAGATTCAAATCTGCTGCCATGTTAGCTGTCTTTGCTGTATCTGCT
GTAGTACACGAATATGCCTTGGCTGTTTGCTTGAGCTTTTTCTATCCCGT
GCTCTTCGTGCTCTTCATGTTCTTTGGAATGGCTTTCAACTTCATTGTCA
A (encoding MS6);

the polynucleotide sequence of
(SEQ ID NO: 455)
ACCATGCCTGCTATTTTAAAGTTACAGAAGAATTGTCTTCTCTCCTTA
(encoding MS8);
and the polynucleotide sequence of
(SEQ ID NO: 380)
TATGAAGCAGGGATGACTCTGGGAGAAAAATTCCGGGTTGGCAATTGCAA
GCATCTCAAAATGACCAGACCC (encoding P82);
and fragments thereof In some embodiments, the RNA corresponding to one or more polynucleotides is selected from the group consisting of:

the polynucleotide sequence of
(SEQ ID NO: 344)
GGAGTTCCAGGAGATTCAACCAGGAGAGCAGTGAGGAGAATGAATACCTT
C (encoding P16);

-continued the polynucleotide sequence of
(SEQ ID NO: 212)
TGCGGGGCCTCTGCCTGTGATGTCTCCCTCATTGCTATGGACAGTGCT (encoding FUS1);

the polynucleotide sequence of
(SEQ ID NO: 350)
TCCCTCTACCACCGGGAGAAGCAGCTCATTGCTATGGACAGTGCTATC (encoding P22);

the polynucleotide sequence of
(SEQ ID NO: 214)
ACCGAATACAACCAGAAATTACAAGTGAATCAATTTAGTGAATCCAAA (encoding FUS2);

the polynucleotide sequence of
(SEQ ID NO: 216)
ACAGAAATTTCATGTTGCACCCTGAGCAGTGAGGAGAATGAATACCTTCC AAGACCAGAGTGGCAGCTCCAG (encoding FUS3);

the polynucleotide sequence of
(SEQ ID NO: 222)
TGTGAGGAGCGCGGCGCGGCAGGAAGCCTTATCAGTTGTGAG (encoding FUS6);

the polynucleotide sequence of
(SEQ ID NO: 220)
AACAGCAAGATGGCTTTGAACTCAGAAGCCTTATCAGTTGTGAGTGAG (encoding FUSS);

the polynucleotide sequence of
(SEQ ID NO: 226)
TGGGGGATGGAGTTGGCAGCGTCTCGGAGGTTCTCCTGGGACCACCACTC

CGCCGGGGGGCCGCCCAGAGTGCCAAGCGTCCGATCCGGCGCCGCCCAAG

TGCAGCCCAAGGACCCGCTCCCGCTCCGCACCCTGGCAGGCTGCCTAGCC

AGGACTGCGCACCTGCGCCCTGGGGCGGAGTCCTTACCCCAACCCCAGCT

TCACTGCACA (encoding FUS8);

the polynucleotide sequence of
(SEQ ID NO: 346)
CACGTGGTGGGCTATGGCCACCTTGATACTTCCGGGTCATCCTCCTCCTC CTCCTGGCCC (encoding FUS15);

the polynucleotide sequence of
(SEQ ID NO: 354)
AACAGCAAGATGGCTTTGAACTCATTAAACTCCATTGATGATGCACAGTT

GACAAGAATTGCCCCTCCAAGATCTCATTGCTGTTTCTGGGAAGTAAACG

CTCCT (encoding P35);

the polynucleotide sequence of
(SEQ ID NO: 236)
AAAATGCACTTCTCCCTCAAGGAGCACCCACCGCCCCCTTGCCCGCCT (encoding FUS19);
and the polynucleotide sequence of
(SEQ ID NO: 224)
CTGTGGTTCCAGAGCAGTGAGCTGTCCCCGACGGGAGCGCCATGGCCCAG

CCGCCGCCCGACGTGGAGGGGGACGACTGTCTCCCCGCGTACCGCCACCT

CTTCTGCCCGGACCTGCTGCGGGACAAAGTGGCCTTCATCACAGGAGGCG

GCTCTGGGATTGGGTTCCGGATTGCTGAGATTTTCATGCGGCACGGCTGC

CATACGG (encoding FUS7),
and fragments thereof

The RNA can correspond to two or more polynucleotides selected from the group consisting of the polynucleotide sequence of
(SEQ ID NO: 344)
GGAGTTCCAGGAGATTCAACCAGGAGAGCAGTGAGGAGAATGAATACCTT C (encoding P16);

the polynucleotide sequence of
(SEQ ID NO: 212)
TGCGGGGCCTCTGCCTGTGATGTCTCCCTCATTGCTATGGACAGTGCT (encoding FUS1);

the polynucleotide sequence of
(SEQ ID NO: 350)
TCCCTCTACCACCGGGAGAAGCAGCTCATTGCTATGGACAGTGCTATC (encoding P22);

the polynucleotide sequence of
(SEQ ID NO: 214)
ACCGAATACAACCAGAAATTACAAGTGAATCAATTTAGTGAATCCAAA (encoding FUS2);

the polynucleotide sequence of
(SEQ ID NO: 216)
ACAGAAATTTCATGTTGCACCCTGAGCAGTGAGGAGAATGAATACCTTCC AAGACCAGAGTGGCAGCTCCAG (encoding FUS3);

the polynucleotide sequence of
(SEQ ID NO: 222)
TGTGAGGAGCGCGGCGCGGCAGGAAGCCTTATCAGTTGTGAG (encoding FUS6);

the polynucleotide sequence of
(SEQ ID NO: 220)
AACAGCAAGATGGCTTTGAACTCAGAAGCCTTATCAGTTGTGAGTGAG (encoding FUS5);

the polynucleotide sequence of
(SEQ ID NO: 226)
TGGGGGATGGAGTTGGCAGCGTCTCGGAGGTTCTCCTGGGACCACCACTC

CGCCGGGGGGCCGCCCAGAGTGCCAAGCGTCCGATCCGGCGCCGCCCAAG

TGCAGCCCAAGGACCCGCTCCCGCTCCGCACCCTGGCAGGCTGCCTAGCC

AGGACTGCGCACCTGCGCCCTGGGGCGGAGTCCTTACCCCAACCCCAGCT

TCACTGCACA (encoding FUS8);

the polynucleotide sequence of
(SEQ ID NO: 346)
CACGTGGTGGGCTATGGCCACCTTGATACTTCCGGGTCATCCTCCTCCTC CTCCTGGCCC (encoding FUS15);

the polynucleotide sequence of
(SEQ ID NO: 354)
AACAGCAAGATGGCTTTGAACTCATTAAACTCCATTGATGATGCACAGTT

GACAAGAATTGCCCCTCCAAGATCTCATTGCTGTTTCTGGGAAGTAAACG

CTCCT (encoding P35);

the polynucleotide sequence of
(SEQ ID NO: 236)
AAAATGCACTTCTCCCTCAAGGAGCACCCACCGCCCCCTTGCCCGCCT (encoding FUS19);
and -continued the polynucleotide sequence of
(SEQ ID NO: 224)
CTGTGGTTCCAGAGCAGTGAGCTGTCCCCGACGGGAGCGCCATGGCCCAG
CCGCCGCCCGACGTGGAGGGGGACGACTGTCTCCCCGCGTACCGCCACCT
CTTCTGCCCGGACCTGCTGCGGGACAAAGTGGCCTTCATCACAGGAGGCG
GCTCTGGGATTGGGTTCCGGATTGCTGAGATTTTCATGCGGCACGGCTGC
CATACGG (encoding FUS7).

In some embodiments, the self-replicating RNA molecule comprises an RNA corresponding to one or more at least 24 nucleotide long contiguous fragments of the one or more polynucleotides, wherein the polynucleotides comprise the polynucleotide sequence of
(SEQ ID NO: 276)
TGGAAATTCGAGATGAGCTACACGGTGGGTGGCCCGCCTCCCCATGTTCA
TGCTAGACCCAGGCATTGGAAAACTGATAGA (encoding AS18);

the polynucleotide sequence of
(SEQ ID NO: 382)
TATGAAGCAGGGATGACTCTGGGAGGTAAGATACTTTTCTTTCTCTTCCT
CCTCCTTCCTCTCTCCCCCTTCTCCCTCATTTTC (encoding P87);

the polynucleotide sequence of
(SEQ ID NO: 334)
GATGGCCACTCCTACACATCCAAGGTGAATTGTTTACTCCTTCAAGATGG
GTTCCATGGCTGTGTGAGCATCACCGGGGCAGCTGGAAGAAGAAACCTGA
GCATCTTCCTGTTCTTGATGCTGTGCAAATTGGAGTTCCATGCTTGT
(encoding AS55);

the polynucleotide sequence of
(SEQ ID NO: 338)
ACAGGGGGCAAAAGCACCTGCTCGGCTCCTGGCCCTCAGTCTCTCCCCTC
CACTCCATTCTCCACCTACCCACAGTGGGTCATTCTGATCACCGAACTG
(encoding AS57);

the polynucleotide sequence of
(SEQ ID NO: 270)
GTGCTGCGCTTTCTGGACTTAAAGGTGAGATACCTGCACTCT
(encoding AS15);

the polynucleotide sequence of
(SEQ ID NO: 254)
GACTACTGGGCTCAAAAGGAGAAGGGATCATCTTCATTCCTGCGACCAT
CCTGT (encoding AS7);

the polynucleotide sequence of
(SEQ ID NO: 310)
GTGCCCTTCCGGGAGCTCAAGAACGTGAGTGTCCTGGAGGGGCTCCGTCA
AGGCCGGCTTGGGGGTCCCTGTTCATGTCACTGCCCAAGACCTTCCCAGG
CCAGGCTCACGCCAGTGGATGTGGCAGGTCCCTTCTTGTGTCTGGGGGAT
CCTGGGCTGTTCCCCCCAGTCAAGAGCAGTATC (encoding AS43);

the polynucleotide sequence of
(SEQ ID NO: 326)
GGCATGGAGTGCACCCTGGGGCAGGTGGGTGCCCCGTCCCCTCGGAGGGA
GGAGGACGGTTGGCGTGGGGGCCACAGCCGATTCAAGGCTGATGTACCAG
CACCGCAGGGACCCTGCTGGGGTGGCCAACCTGGCTCTGCCCCCTCCTCA
GCTCCTCCTGAACAGTCATTATTAGAT (encoding AS51);

-continued the polynucleotide sequence of
((SEQ ID NO: 272)
GGCAACACCACCCTCCAGCAGCTGGGTGAGGCCTCCCAGGCGCCCTCAGG
CTCCCTCATCCCTCTGAGGCTGCCTCTGCTCTGGGAAGTGAGGGGC
(encoding AS16);

the polynucleotide sequence of
(SEQ ID NO: 306)
GAGGCCTTCCAGAGGGCCGCTGGTGAGGGCGGCCCGGGCCGCGGTGGGGC
ACGGCGCGGTGCCAGGGTGTTGCAGAGCCCCTTTTGCAGGGCAGGAGCTG
GGGAGTGGTTAGGACATCAGTCCCTCAGG (encoding AS41);

the polynucleotide sequence of
(SEQ ID NO: 252)
GACTACTGGGCTCAAAAGGAGAAGATCAGCATCCCCAGAACACACCTGTG
T (encoding AS6);

the polynucleotide sequence of
(SEQ ID NO: 246)
GTTGCTATGATGGTTCCTGATAGACAGGTTCATTATGACTTTGGATTG
(encoding AS3);

the polynucleotide sequence of
(SEQ ID NO: 262)
GTGCCCTTCCGGGAGCTCAAGAACCAGAGAACAGCACAAGGGGCTCCTGG
GATCCACCACGCGGCTTCCCCCGTTGCTGCCAACCTCTGCGACCCGGCGA
GACACGCACAGCACACACGCATCCCCTGCGGCGCTGGCCAAGTGCGTGCT
GGCCGAGGTCCCGAAGCAGGTGGTGGAGTACTACAGCCACAGAGGCCTGC
CCCCGAGAAGCCTGGGTGTCCCTGCCGGAGAGGCCAGCCCAGGCTGCACA
CCGTGAAGATGTGGAGGGCG (encoding AS11);

the polynucleotide sequence of
(SEQ ID NO: 266)
AAGAGAAGTTTTGCTGTCACGGAGAGGATCATC (encoding AS13);

the polynucleotide sequence of
(SEQ ID NO: 318)
TTCAAGAAGTTCGACGGCCCTTGTGGTGAGCGCGGCGGCGGGCGCACGGC
TCGAGCTCTGTGGGCGCGCGGCGACAGCGTCCTGACTCCTGCCCTCGACC
CCCAGACCCCTGTCAGGGCGCCCTCCCTGACCCGAGCCGCAGCTGCCGTG
(encoding AS47);

the polynucleotide sequence of
(SEQ ID NO: 256)
CTTGTACTTGGTGTATTGAGCGGGCACAGTGGCTCACGCCTA
(encoding AS8);

the polynucleotide sequence of
(SEQ ID NO: 278)
CAGTGGCAGCACTACCACCGGTCAGGTGAGGCCGCAGGGACTCCCCTCTG
GAGACCCACAAGAAAC (encoding AS19);

the polynucleotide sequence of
(SEQ ID NO: 298)
TGCCACCTCTTCCTGCAGCCCCAGGTTGGCACCCCCCCCCCCCACACTGC
CAGTGCTCGAGCCCCCAGTGGTCCACCCCACCCTCATGAAAGTTGCCCTG
CAGGGCGAAGACCTGCGAGAGCTGCGCAGACATGTGCACGCCGACAGCAC
GGACTTCCTGGCTGTGAAGAGGCTGGTACAGCGCGTGTTCCCAGCCTGCA -continued

CCTGCACCTGCACCAGGCCGCCCTCGGAGCAGGAAGGGGCCGTGGGTGGG

GAGAGGCCTGTGCCCAAGTACCCCCCTCAAGAGGC (encoding AS37);

the polynucleotide sequence of (SEQ ID NO: 286)

AAAATTCAGAATAAAAATTGTCCAGAC (encoding AS23);

the polynucleotide sequence of (SEQ ID NO: 448)

CACTACAAATTAATTCAACAACCCATATCCCTCTTCTCCATCACTGATAG

GCTCCATAAGACGTTCAGTCAGCTGCCCTCGGTCCATCTCTGCTCAATCA

CCTTCCAGTGGGGACACCCGCCCATTTTCTGCTCAACAAATGATATCTGT

GTCACGGCCAACTTCTGCATCTCGGTCACATTCCTTAAACCGTGCTTCCT

CCTACATGAGGCATCTGCCTCACAG (encoding MS1);

the polynucleotide sequence of (SEQ ID NO: 450)

AGGACCGCCCTGACACACAATCAGGACTTCTCTATCTACAGGCTCTGTTG

CAAGAGGGGGTCCCTCTGCCACGCTTCCCAGGCCAGATCCCCGGCTTTCC

CGAAGCCGGTCAGACCTCTTCCTGCCCCCATCACCAGAATCACCCCCCAA

CTGGGGGGACAATCTGACTCGAGTCAACCCCTTCTCACTACGGGAAGACC

TCAGGGGTGGCAAGATCAAGCTCTTAGACACACCCAGCAAGCCAGTCCTG

CCTCTTGTGCCACCATCACCATTCCCATCCACTCAGCTGCCCTTGGTGAC

CACTCCGGAGACCCTGGTCCAGCCTGGGACACCTGCCCGCCGCTGCCGCT

CACTACCCTCATCCCCCGAGCTCCCCCGCCGTATGGAGACAGCACTGCCA

GGTCCTGGCCCTCCCGCTGTGGGCCCCTCGGC (encoding MS3);

the polynucleotide sequence of (SEQ ID NO: 453)

TATGCTTACAAGGACTTTCTCTGGTGTTTTCCTTTTTCTTTAGTTTTTCT

CCAAGAGATTCAAATCTGCTGCCATGTTAGCTGTCTTTGCTGTATCTGCT

GTAGTACACGAATATGCCTTGGCTGTTTGCTTGAGCTTTTTCTATCCCGT

GCTCTTCGTGCTCTTCATGTTCTTTGGAATGGCTTTCAACTTCATTGTCA

A (encoding MS6);

the polynucleotide sequence of (SEQ ID NO: 455)

ACCATGCCTGCTATTTTAAAGTTACAGAAGAATTGTCTTCTCTCCTTA (encoding MS8);

and the polynucleotide sequence of (SEQ ID NO: 380)

TATGAAGCAGGGATGACTCTGGGAGAAAAATTCCGGGTTGGCAATTGCAA

GCATCTCAAAATGACCAGACCC (encoding P82), and fragments thereof

In some embodiments, the self-replicating RNA molecule comprises an RNA corresponding to one or more polynucleotides selected from the group consisting of the polynucleotide sequence of (SEQ ID NO: 168)

ATTGCGAGAGAGCTGCATCAGTTCGCTTTTGACCTGCTAATCAAGTCACA

C (encoding M84);

-continued the polynucleotide sequence of (SEQ ID NO: 172)

CAGCCCGACTCCTTTGCAGCCTTGCACTCTAGCCTCAATGAACTGGGAGA

G (encoding M86);

the polynucleotide sequence of (SEQ ID NO: 20)

TTTGTGCAAGGCAAAGACTGGGGATTAAAGAAATTCATCCGTAGAGATTT

T (encoding M10);

the polynucleotide sequence of (SEQ ID NO: 24)

TTTGTGCAAGGCAAAGACTGGGGAGTCAAGAAATTCATCCGTAGAGATTT

T (encoding M12);

and the polynucleotide sequence of (SEQ ID NO: 178)

CAGAACCTGCAGAATGGAGGGGGGAGCAGGTCTTCAGCCACACTGCCGGG

GCGGCGGCGGCGGCGGTGGCTGCGGCGGCGGCGGCAGCCAATATCAGTAG

CTCCTGCGGGGCCCCCTCGCCGACCAAACCAAAAACCAAACCCACCTGGC

GGTGCGAGGTGTGTGATTATGAGACCAACGTGGCCAGGAACCTCCGCATT

CACA (encoding FR1);

and fragments thereof

The disclosure also provides self-replicating RNA molecules comprising an RNA encoding one or more polynucleotides selected from the group consisting of SEQ ID NOs: 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498 and 499, and fragments thereof.

The disclosure also provides self-replicating RNA molecules comprising an RNA encoding one or more polynucleotides selected from the group consisting of SEQ ID NOs: 500, 501, 461, 503, 504, 505, 506, 507, 508, 509, 510, 511, 512, 513, 514, 515, 516, 517, 477, 519, 520, 521, 522, 523, 524, 525, 485, 486, 528, 529, 530, 531, 532, 533, 534, 535, 536, 537, 538, 539 and 540, and fragments thereof.

The disclosure also provides self-replicating RNA molecules comprising an RNA encoding a polypeptide comprising SEQ ID NOs: 541, 543, 550, 552, 554, 555, 556, 557, 558, 559, 623, or 624, 625 or 626.

In some embodiments, the fragments comprised in the self-replicating RNA molecule comprise at least 18 nucleotides. In some embodiments, the fragments comprise at least 21 nucleotides. In some embodiments, the fragments comprise at least 24 nucleotides. In some embodiments, the fragments comprise at least 27 nucleotides. In some embodiments, the fragments comprise at least 30 nucleotides. In some embodiments, the fragments comprise at least 33 nucleotides. In some embodiments, the fragments comprise at least 36 nucleotides. In some embodiments, the fragments comprise at least 39 nucleotides. In some embodiments, the fragments comprise at least 42 nucleotides. In some embodiments, the fragments comprise at least 45 nucleotides. In some embodiments, the fragments comprise at least 48 nucleotides. In some embodiments, the fragments comprise at least 51 nucleotides. In some embodiments, the fragments comprise at least 54 nucleotides. In some embodiments, the fragments comprise at least 57 nucleotides. In some embodiments, the fragments comprise at least 60 nucleotides. In some embodiments, the fragments comprise at least 63 nucleotides. In some embodiments, the fragments comprise at least 66 nucleotides. In some embodiments, the fragments comprise at least 69 nucleotides. In some embodiments, the fragments comprise at least 72 nucleotides. In some embodiments, the fragments comprise at least 75 nucleotides. In some embodiments, the fragments comprise about 18 nucleotides. In some embodiments, the fragments comprise about 21 nucleotides. In some embodiments, the fragments comprise about 24 nucleotides. In some embodiments, the fragments comprise about 27 nucleotides. In some embodiments, the fragments comprise about 30 nucleotides. In some embodiments, the fragments comprise about 33 nucleotides. In some embodiments, the fragments comprise about 36 nucleotides. In some embodiments, the fragments comprise about 39 nucleotides. In some embodiments, the fragments comprise about 42 nucleotides. In some embodiments, the fragments comprise about 45 nucleotides. In some embodiments, the fragments comprise about 48 nucleotides. In some embodiments, the fragments comprise about 51 nucleotides. In some embodiments, the fragments comprise about 54 nucleotides. In some embodiments, the fragments comprise about 57 nucleotides. In some embodiments, the fragments comprise about 60 nucleotides. In some embodiments, the fragments comprise about 63 nucleotides. In some embodiments, the fragments comprise about 66 nucleotides. In some embodiments, the fragments comprise about 69 nucleotides. In some embodiments, the fragments comprise about 72 nucleotides. In some embodiments, the fragments comprise about 75 nucleotides. In some embodiments, the fragments comprise about 18-75 nucleotides. In some embodiments, the fragments comprise about 21-75 nucleotides. In some embodiments, the fragments comprise about 24-75 nucleotides. In some embodiments, the fragments comprise about 24-72 nucleotides. In some embodiments, the fragments comprise about 24-69 nucleotides. In some embodiments, the fragments comprise about 24-66 nucleotides. In some embodiments, the fragments comprise about 24-63 nucleotides. In some embodiments, the fragments comprise about 24-60 nucleotides. In some embodiments, the fragments comprise about 24-57 nucleotides. In some embodiments, the fragments comprise about 24-54 nucleotides. In some embodiments, the fragments comprise about 24-51 nucleotides. In some embodiments, the fragments comprise about 24-48 nucleotides. In some embodiments, the fragments comprise about 24-45 nucleotides. In some embodiments, the fragments comprise about 24-42 nucleotides. In some embodiments, the fragments comprise about 27-42 nucleotides. In some embodiments, the fragments comprise about 27-39 nucleotides. In some embodiments, the fragments comprise about 27-36 nucleotides. In some embodiments, the fragments comprise about 27-33 nucleotides. In some embodiments, the fragments comprise about 27-30 nucleotides.

The disclosed self-replicating RNA molecules contain polynucleotides that encode the prostate neoantigens and polypeptides comprising one or more prostate neoantigens described herein. The self-replicating RNA molecules are useful in generating the polypeptides, the vectors, the recombinant viruses, the cells, and the vaccines of the disclosure. The self-replicating RNA molecules may be utilized as therapeutics by delivering the neoantigens to a subject having a prostate cancer using various technologies, including viral vectors as described herein or other delivery technologies as also described herein. The one or more neoantigens (e.g. polypeptides) may be incorporated into the vaccine in any order using standard cloning methods.

The disclosure also provides a self-replicating RNA molecule comprising an RNA encoding the polypeptide of SEQ ID NO: 1 or a fragment thereof. In some embodiments, the self-replicating RNA molecule comprises an RNA corresponding to the polynucleotide of SEQ ID NO: 2 or a fragment thereof.

The disclosure also provides a self-replicating RNA molecule comprising an RNA encoding the polypeptide of SEQ ID NO: 3 or a fragment thereof. In some embodiments, the self-replicating RNA molecule comprises an RNA corresponding to the polynucleotide of SEQ ID NO: 4 or a fragment thereof.

The disclosure also provides a self-replicating RNA molecule comprising an RNA encoding the polypeptide of SEQ ID NO: 5 or a fragment thereof. In some embodiments, the self-replicating RNA molecule comprises an RNA corresponding to the polynucleotide of SEQ ID NO: 6 or a fragment thereof.

The disclosure also provides a self-replicating RNA molecule comprising an RNA encoding the polypeptide of SEQ ID NO: 7 or a fragment thereof. In some embodiments, the self-replicating RNA molecule comprises an RNA corresponding to the polynucleotide of SEQ ID NO: 8 or a fragment thereof.

The disclosure also provides a self-replicating RNA molecule comprising an RNA encoding the polypeptide of SEQ ID NO: 9 or a fragment thereof. In some embodiments, the self-replicating RNA molecule comprises an RNA corresponding to the polynucleotide of SEQ ID NO: 10 or a fragment thereof.

The disclosure also provides a self-replicating RNA molecule comprising an RNA encoding the polypeptide of SEQ ID NO: 11 or a fragment thereof. In some embodiments, the self-replicating RNA molecule comprises an RNA corresponding to the polynucleotide of SEQ ID NO: 12 or a fragment thereof.

The disclosure also provides a self-replicating RNA molecule comprising an RNA encoding the polypeptide of SEQ ID NO: 13 or a fragment thereof. In some embodiments, the self-replicating RNA molecule comprises an RNA corresponding to the polynucleotide of SEQ ID NO: 14 or a fragment thereof.

The disclosure also provides a self-replicating RNA molecule comprising an RNA encoding the polypeptide of SEQ ID NO: 15 or a fragment thereof. In some embodiments, the self-replicating RNA molecule comprises an RNA corresponding to the polynucleotide of SEQ ID NO: 16 or a fragment thereof.

The disclosure also provides a self-replicating RNA molecule comprising an RNA encoding the polypeptide of SEQ ID NO: 17 or a fragment thereof. In some embodiments, the self-replicating RNA molecule comprises an RNA corresponding to the polynucleotide of SEQ ID NO: 18 or a fragment thereof.

The disclosure also provides a self-replicating RNA molecule comprising an RNA encoding the polypeptide of SEQ ID NO: 19 or a fragment thereof. In some embodiments, the self-replicating RNA molecule comprises an RNA corresponding to the polynucleotide of SEQ ID NO: 20 or a fragment thereof. In some embodiments, the self-replicating RNA molecule comprises an RNA corresponding to the polynucleotide of SEQ ID NO: 497 or a fragment thereof. In some embodiments, the self-replicating RNA molecule comprises an RNA corresponding to the polynucleotide of SEQ ID NO: 538 or a fragment thereof.

The disclosure also provides a self-replicating RNA molecule comprising an RNA encoding the polypeptide of SEQ ID NO: 21 or a fragment thereof. In some embodiments, the self-replicating RNA molecule comprising an RNA corresponding to the polynucleotide of SEQ ID NO: 22 or a fragment thereof.

The disclosure also provides a self-replicating RNA molecule comprising an RNA encoding the polypeptide of SEQ ID NO: 23 or a fragment thereof. In some embodiments, the self-replicating RNA molecule comprises an RNA corresponding to the polynucleotide of SEQ ID NO: 24 or a fragment thereof. In some embodiments, the self-replicating RNA molecule comprises an RNA corresponding to the polynucleotide of SEQ ID NO: 498 or a fragment thereof. In some embodiments, the polypeptide of SEQ ID NO: 23, or a fragment thereof, is encoded by the polynucleotide of SEQ ID NO: 539 or a fragment thereof.

The disclosure also provides a self-replicating RNA molecule comprising an RNA encoding the polypeptide of SEQ ID NO: 25 or a fragment thereof. In some embodiments, the self-replicating RNA molecule comprises an RNA corresponding to the polynucleotide of SEQ ID NO: 26 or a fragment thereof.

The disclosure also provides a self-replicating RNA molecule comprising an RNA encoding the polypeptide of SEQ ID NO: 27 or a fragment thereof. In some embodiments, the self-replicating RNA molecule comprises an RNA corresponding to the polynucleotide of SEQ ID NO: 28 or a fragment thereof.

The disclosure also provides a self-replicating RNA molecule comprising an RNA encoding the polypeptide of SEQ ID NO: 29 or a fragment thereof. In some embodiments, the self-replicating RNA molecule comprises an RNA corresponding to the polynucleotide of SEQ ID NO: 30 or a fragment thereof.

The disclosure also provides a self-replicating RNA molecule comprising an RNA encoding the polypeptide of SEQ ID NO: 31 or a fragment thereof. In some embodiments, the self-replicating RNA molecule comprises an RNA corresponding to the polynucleotide of SEQ ID NO: 32 or a fragment thereof.

The disclosure also provides a self-replicating RNA molecule comprising an RNA encoding the polypeptide of SEQ ID NO: 33 or a fragment thereof. In some embodiments, the self-replicating RNA molecule comprises an RNA corresponding to the polynucleotide of SEQ ID NO: 34 or a fragment thereof.

The disclosure also provides a self-replicating RNA molecule comprising an RNA encoding the polypeptide of SEQ ID NO: 35 or a fragment thereof. In some embodiments, the self-replicating RNA molecule comprises an RNA corresponding to the polynucleotide of SEQ ID NO: 36 or a fragment thereof.

The disclosure also provides a self-replicating RNA molecule comprising an RNA encoding the polypeptide of SEQ ID NO: 37 or a fragment thereof. In some embodiments, the self-replicating RNA molecule comprises an RNA corresponding to the polynucleotide of SEQ ID NO: 38 or a fragment thereof.

The disclosure also provides a self-replicating RNA molecule comprising an RNA encoding the polypeptide of SEQ ID NO: 39 or a fragment thereof. In some embodiments, the self-replicating RNA molecule comprises an RNA corresponding to the polynucleotide of SEQ ID NO: 40 or a fragment thereof.

The disclosure also provides a self-replicating RNA molecule comprising an RNA encoding the polypeptide of SEQ ID NO: 41 or a fragment thereof. In some embodiments, the self-replicating RNA molecule comprises an RNA corresponding to the polynucleotide of SEQ ID NO: 42 or a fragment thereof.

The disclosure also provides a self-replicating RNA molecule comprising an RNA encoding the polypeptide of SEQ ID NO: 43 or a fragment thereof. In some embodiments, the self-replicating RNA molecule comprises an RNA corresponding to the polynucleotide of SEQ ID NO: 44 or a fragment thereof.

The disclosure also provides a self-replicating RNA molecule comprising an RNA encoding the polypeptide of SEQ ID NO: 45 or a fragment thereof. In some embodiments, the self-replicating RNA molecule comprises an RNA corresponding to the polynucleotide of SEQ ID NO: 46 or a fragment thereof.

The disclosure also provides a self-replicating RNA molecule comprising an RNA encoding the polypeptide of SEQ ID NO: 47 or a fragment thereof. In some embodiments, the self-replicating RNA molecule comprises an RNA corresponding to the polynucleotide of SEQ ID NO: 48 or a fragment thereof.

The disclosure also provides a self-replicating RNA molecule comprising an RNA encoding the polypeptide of SEQ ID NO: 49 or a fragment thereof. In some embodiments, the self-replicating RNA molecule comprises an RNA corresponding to the polynucleotide of SEQ ID NO: 50 or a fragment thereof.

The disclosure also provides a self-replicating RNA molecule comprising an RNA encoding the polypeptide of SEQ ID NO: 51 or a fragment thereof. In some embodiments, the self-replicating RNA molecule comprises an RNA corresponding to the polynucleotide of SEQ ID NO: 52 or a fragment thereof.

The disclosure also provides a self-replicating RNA molecule comprising an RNA encoding the polypeptide of SEQ ID NO: 53 or a fragment thereof. In some embodiments, the self-replicating RNA molecule comprises an RNA corresponding to the polynucleotide of SEQ ID NO: 54 or a fragment thereof.

The disclosure also provides a self-replicating RNA molecule comprising an RNA encoding the polypeptide of SEQ ID NO: 55 or a fragment thereof. In some embodiments, the self-replicating RNA molecule comprises an RNA corresponding to the polynucleotide of SEQ ID NO: 56 or a fragment thereof.

The disclosure also provides a self-replicating RNA molecule comprising an RNA encoding the polypeptide of SEQ ID NO: 57 or a fragment thereof. In some embodiments, the self-replicating RNA molecule comprises an RNA corresponding to the polynucleotide of SEQ ID NO: 58 or a fragment thereof.

The disclosure also provides a self-replicating RNA molecule comprising an RNA encoding the polypeptide of SEQ ID NO: 59 or a fragment thereof. In some embodiments, the self-replicating RNA molecule comprises an RNA corresponding to the polynucleotide of SEQ ID NO: 60 or a fragment thereof.

The disclosure also provides a self-replicating RNA molecule comprising an RNA encoding the polypeptide of SEQ ID NO: 61 or a fragment thereof. In some embodiments, the self-replicating RNA molecule comprises an RNA corresponding to the polynucleotide of SEQ ID NO: 62 or a fragment thereof.

The disclosure also provides a self-replicating RNA molecule comprising an RNA encoding the polypeptide of SEQ ID NO: 63 or a fragment thereof. In some embodiments, the self-replicating RNA molecule comprises an RNA corresponding to the polynucleotide of SEQ ID NO: 64 or a fragment thereof.

The disclosure also provides a self-replicating RNA molecule comprising an RNA encoding the polypeptide of SEQ ID NO: 65 or a fragment thereof. In some embodiments, the self-replicating RNA molecule comprises an RNA corresponding to the polynucleotide of SEQ ID NO: 66 or a fragment thereof.

The disclosure also provides a self-replicating RNA molecule comprising an RNA encoding the polypeptide of SEQ ID NO: 67 or a fragment thereof. In some embodiments, the self-replicating RNA molecule comprises an RNA corresponding to the polynucleotide of SEQ ID NO: 68 or a fragment thereof.

The disclosure also provides a self-replicating RNA molecule comprising an RNA encoding the polypeptide of SEQ ID NO: 69 or a fragment thereof. In some embodiments, the self-replicating RNA molecule comprises an RNA corresponding to the polynucleotide of SEQ ID NO: 70 or a fragment thereof.

The disclosure also provides a self-replicating RNA molecule comprising an RNA encoding the polypeptide of SEQ ID NO: 71 or a fragment thereof. In some embodiments, the self-replicating RNA molecule comprises an RNA corresponding to the polynucleotide of SEQ ID NO: 72 or a fragment thereof.

The disclosure also provides a self-replicating RNA molecule comprising an RNA encoding the polypeptide of SEQ ID NO: 73 or a fragment thereof. In some embodiments, the self-replicating RNA molecule comprises an RNA corresponding to the polynucleotide of SEQ ID NO: 74 or a fragment thereof.

The disclosure also provides a self-replicating RNA molecule comprising an RNA encoding the polypeptide of SEQ ID NO: 75 or a fragment thereof. In some embodiments, the self-replicating RNA molecule comprises an RNA corresponding to the polynucleotide of SEQ ID NO: 76 or a fragment thereof.

The disclosure also provides a self-replicating RNA molecule comprising an RNA encoding the polypeptide of SEQ ID NO: 77 or a fragment thereof. In some embodiments, the self-replicating RNA molecule comprises an RNA corresponding to the polynucleotide of SEQ ID NO: 78 or a fragment thereof.

The disclosure also provides a self-replicating RNA molecule comprising an RNA encoding the polypeptide of SEQ ID NO: 79 or a fragment thereof. In some embodiments, the self-replicating RNA molecule comprises an RNA corresponding to the polynucleotide of SEQ ID NO: 80 or a fragment thereof.

The disclosure also provides a self-replicating RNA molecule comprising an RNA encoding the polypeptide of SEQ ID NO: 81 or a fragment thereof. In some embodiments, the self-replicating RNA molecule comprises an RNA corresponding to the polynucleotide of SEQ ID NO: 82 or a fragment thereof.

The disclosure also provides a self-replicating RNA molecule comprising an RNA encoding the polypeptide of SEQ ID NO: 83 or a fragment thereof. In some embodiments, the self-replicating RNA molecule comprises an RNA corresponding to the polynucleotide of SEQ ID NO: 84 or a fragment thereof.

The disclosure also provides a self-replicating RNA molecule comprising an RNA encoding the polypeptide of SEQ ID NO: 85 or a fragment thereof. In some embodiments, the self-replicating RNA molecule comprises an RNA corresponding to the polynucleotide of SEQ ID NO: 86 or a fragment thereof.

The disclosure also provides a self-replicating RNA molecule comprising an RNA encoding the polypeptide of SEQ ID NO: 87 or a fragment thereof. In some embodiments, the self-replicating RNA molecule comprises an RNA corresponding to the polynucleotide of SEQ ID NO: 88 or a fragment thereof.

The disclosure also provides a self-replicating RNA molecule comprising an RNA encoding the polypeptide of SEQ ID NO: 89 or a fragment thereof. In some embodiments, the self-replicating RNA molecule comprises an RNA corresponding to the polynucleotide of SEQ ID NO: 90 or a fragment thereof.

The disclosure also provides a self-replicating RNA molecule comprising an RNA encoding the polypeptide of SEQ ID NO: 91 or a fragment thereof. In some embodiments, the self-replicating RNA molecule comprises an RNA corresponding to the polynucleotide of SEQ ID NO: 92 or a fragment thereof.

The disclosure also provides a self-replicating RNA molecule comprising an RNA encoding the polypeptide of SEQ ID NO: 93 or a fragment thereof. In some embodiments, the self-replicating RNA molecule comprises an RNA corresponding to the polynucleotide of SEQ ID NO: 94 or a fragment thereof.

The disclosure also provides a self-replicating RNA molecule comprising an RNA encoding the polypeptide of SEQ ID NO: 95 or a fragment thereof. In some embodiments, the self-replicating RNA molecule comprises an RNA corresponding to the polynucleotide of SEQ ID NO: 96 or a fragment thereof.

The disclosure also provides a self-replicating RNA molecule comprising an RNA encoding the polypeptide of SEQ ID NO: 97 or a fragment thereof. In some embodiments, the self-replicating RNA molecule comprises an RNA corresponding to the polynucleotide of SEQ ID NO: 98 or a fragment thereof.

The disclosure also provides a self-replicating RNA molecule comprising an RNA encoding the polypeptide of SEQ ID NO: 99 or a fragment thereof. In some embodiments, the self-replicating RNA molecule comprises an RNA corresponding to the polynucleotide of SEQ ID NO: 100 or a fragment thereof.

The disclosure also provides a self-replicating RNA molecule comprising an RNA encoding the polypeptide of SEQ ID NO: 101 or a fragment thereof. In some embodiments, the self-replicating RNA molecule comprises an RNA corresponding to the polynucleotide of SEQ ID NO: 102 or a fragment thereof.

The disclosure also provides a self-replicating RNA molecule comprising an RNA encoding the polypeptide of SEQ ID NO: 103 or a fragment thereof. In some embodiments, the self-replicating RNA molecule comprises an RNA corresponding to the polynucleotide of SEQ ID NO: 104 or a fragment thereof.

The disclosure also provides a self-replicating RNA molecule comprising an RNA encoding the polypeptide of SEQ ID NO: 105 or a fragment thereof. In some embodiments, the self-replicating RNA molecule comprises an RNA corresponding to the polynucleotide of SEQ ID NO: 106 or a fragment thereof.

The disclosure also provides a self-replicating RNA molecule comprising an RNA encoding the polypeptide of SEQ ID NO: 107 or a fragment thereof. In some embodiments, the self-replicating RNA molecule comprises an RNA corresponding to the polynucleotide of SEQ ID NO: 108 or a fragment thereof.

The disclosure also provides a self-replicating RNA molecule comprising an RNA encoding the polypeptide of SEQ ID NO: 109 or a fragment thereof. In some embodiments, the self-replicating RNA molecule comprises an RNA corresponding to the polynucleotide of SEQ ID NO: 110 or a fragment thereof.

The disclosure also provides a self-replicating RNA molecule comprising an RNA encoding the polypeptide of SEQ ID NO: 111 or a fragment thereof. In some embodiments, the self-replicating RNA molecule comprises an RNA corresponding to the polynucleotide of SEQ ID NO: 112 or a fragment thereof.

The disclosure also provides a self-replicating RNA molecule comprising an RNA encoding the polypeptide of SEQ ID NO: 113 or a fragment thereof. In some embodiments, the self-replicating RNA molecule comprises an RNA corresponding to the polynucleotide of SEQ ID NO: 114 or a fragment thereof.

The disclosure also provides a self-replicating RNA molecule comprising an RNA encoding the polypeptide of SEQ ID NO: 115 or a fragment thereof. In some embodiments, the self-replicating RNA molecule comprises an RNA corresponding to the polynucleotide of SEQ ID NO: 116 or a fragment thereof.

The disclosure also provides a self-replicating RNA molecule comprising an RNA encoding the polypeptide of SEQ ID NO: 117 or a fragment thereof. In some embodiments, the self-replicating RNA molecule comprises an RNA corresponding to the polynucleotide of SEQ ID NO: 118 or a fragment thereof.

The disclosure also provides a self-replicating RNA molecule comprising an RNA encoding the polypeptide of SEQ ID NO: 119 or a fragment thereof. In some embodiments, the self-replicating RNA molecule comprises an RNA corresponding to the polynucleotide of SEQ ID NO: 120 or a fragment thereof.

The disclosure also provides a self-replicating RNA molecule comprising an RNA encoding the polypeptide of SEQ ID NO: 121 or a fragment thereof. In some embodiments, the self-replicating RNA molecule comprises an RNA corresponding to the polynucleotide of SEQ ID NO: 122 or a fragment thereof.

The disclosure also provides a self-replicating RNA molecule comprising an RNA encoding the polypeptide of SEQ ID NO: 123 or a fragment thereof. In some embodiments, the self-replicating RNA molecule comprises an RNA corresponding to the polynucleotide of SEQ ID NO: 124 or a fragment thereof.

The disclosure also provides a self-replicating RNA molecule comprising an RNA encoding the polypeptide of SEQ ID NO: 125 or a fragment thereof. In some embodiments, the self-replicating RNA molecule comprises an RNA corresponding to the polynucleotide of SEQ ID NO: 126 or a fragment thereof.

The disclosure also provides a self-replicating RNA molecule comprising an RNA encoding the polypeptide of SEQ ID NO: 127 or a fragment thereof. In some embodiments, the self-replicating RNA molecule comprises an RNA corresponding to the polynucleotide of SEQ ID NO: 128 or a fragment thereof.

The disclosure also provides a self-replicating RNA molecule comprising an RNA encoding the polypeptide of SEQ ID NO: 129 or a fragment thereof. In some embodiments, the self-replicating RNA molecule comprises an RNA corresponding to the polynucleotide of SEQ ID NO: 130 or a fragment thereof.

The disclosure also provides a self-replicating RNA molecule comprising an RNA encoding the polypeptide of SEQ ID NO: 131 or a fragment thereof. In some embodiments, the self-replicating RNA molecule comprises an RNA corresponding to the polynucleotide of SEQ ID NO: 132 or a fragment thereof.

The disclosure also provides a self-replicating RNA molecule comprising an RNA encoding the polypeptide of SEQ ID NO: 133 or a fragment thereof. In some embodiments, the self-replicating RNA molecule comprises an RNA corresponding to the polynucleotide of SEQ ID NO: 134 or a fragment thereof.

The disclosure also provides a self-replicating RNA molecule comprising an RNA encoding the polypeptide of SEQ ID NO: 135 or a fragment thereof. In some embodiments, the self-replicating RNA molecule comprises an RNA corresponding to the polynucleotide of SEQ ID NO: 136 or a fragment thereof.

The disclosure also provides a self-replicating RNA molecule comprising an RNA encoding the polypeptide of SEQ ID NO: 137 or a fragment thereof. In some embodiments, the self-replicating RNA molecule comprises an RNA corresponding to the polynucleotide of SEQ ID NO: 138 or a fragment thereof.

The disclosure also provides a self-replicating RNA molecule comprising an RNA encoding the polypeptide of SEQ ID NO: 139 or a fragment thereof. In some embodiments, the self-replicating RNA molecule comprises an RNA corresponding to the polynucleotide of SEQ ID NO: 140 or a fragment thereof.

The disclosure also provides a self-replicating RNA molecule comprising an RNA encoding the polypeptide of SEQ ID NO: 141 or a fragment thereof. In some embodiments, the self-replicating RNA molecule comprises an RNA corresponding to the polynucleotide of SEQ ID NO: 142 or a fragment thereof.

The disclosure also provides a self-replicating RNA molecule comprising an RNA encoding the polypeptide of SEQ ID NO: 143 or a fragment thereof. In some embodiments, the self-replicating RNA molecule comprises an RNA corresponding to the polynucleotide of SEQ ID NO: 144 or a fragment thereof.

The disclosure also provides a self-replicating RNA molecule comprising an RNA encoding the polypeptide of SEQ ID NO: 145 or a fragment thereof. In some embodiments, the self-replicating RNA molecule comprises an RNA corresponding to the polynucleotide of SEQ ID NO: 146 or a fragment thereof.

The disclosure also provides a self-replicating RNA molecule comprising an RNA encoding the polypeptide of SEQ ID NO: 147 or a fragment thereof. In some embodiments, the self-replicating RNA molecule comprises an RNA corresponding to the polynucleotide of SEQ ID NO: 148 or a fragment thereof.

The disclosure also provides a self-replicating RNA molecule comprising an RNA encoding the polypeptide of SEQ ID NO: 149 or a fragment thereof. In some embodiments, the self-replicating RNA molecule comprises an RNA corresponding to the polynucleotide of SEQ ID NO: 150 or a fragment thereof.

The disclosure also provides a self-replicating RNA molecule comprising an RNA encoding the polypeptide of SEQ ID NO: 151 or a fragment thereof. In some embodiments, the self-replicating RNA molecule comprises an RNA corresponding to the polynucleotide of SEQ ID NO: 152 or a fragment thereof.

The disclosure also provides a self-replicating RNA molecule comprising an RNA encoding the polypeptide of SEQ ID NO: 153 or a fragment thereof. In some embodiments, the self-replicating RNA molecule comprises an RNA corresponding to the polynucleotide of SEQ ID NO: 154 or a fragment thereof.

The disclosure also provides a self-replicating RNA molecule comprising an RNA encoding the polypeptide of SEQ ID NO: 155 or a fragment thereof. In some embodiments, the self-replicating RNA molecule comprises an RNA corresponding to the polynucleotide of SEQ ID NO: 156 or a fragment thereof.

The disclosure also provides a self-replicating RNA molecule comprising an RNA encoding the polypeptide of SEQ ID NO: 157 or a fragment thereof. In some embodiments, the self-replicating RNA molecule comprises an RNA corresponding to the polynucleotide of SEQ ID NO: 158 or a fragment thereof.

The disclosure also provides a self-replicating RNA molecule comprising an RNA encoding the polypeptide of SEQ ID NO: 159 or a fragment thereof. In some embodiments, the self-replicating RNA molecule comprises an RNA corresponding to the polynucleotide of SEQ ID NO: 160 or a fragment thereof.

The disclosure also provides a self-replicating RNA molecule comprising an RNA encoding the polypeptide of SEQ ID NO: 161 or a fragment thereof. In some embodiments, the self-replicating RNA molecule comprises an RNA corresponding to the polynucleotide of SEQ ID NO: 162 or a fragment thereof.

The disclosure also provides a self-replicating RNA molecule comprising an RNA encoding the polypeptide of SEQ ID NO: 163 or a fragment thereof. In some embodiments, the self-replicating RNA molecule comprises an RNA corresponding to the polynucleotide of SEQ ID NO: 164 or a fragment thereof.

The disclosure also provides a self-replicating RNA molecule comprising an RNA encoding the polypeptide of SEQ ID NO: 165 or a fragment thereof. In some embodiments, the self-replicating RNA molecule comprises an RNA corresponding to the polynucleotide of SEQ ID NO: 166 or a fragment thereof.

The disclosure also provides a self-replicating RNA molecule comprising an RNA encoding the polypeptide of SEQ ID NO: 167 or a fragment thereof. In some embodiments, the self-replicating RNA molecule comprises an RNA corresponding to the polynucleotide of SEQ ID NO: 168 or a fragment thereof. In some embodiments, the self-replicating RNA molecule comprises an RNA corresponding to the polynucleotide of SEQ ID NO: 495 or a fragment thereof. In some embodiments, the self-replicating RNA molecule comprises an RNA corresponding to the polynucleotide of SEQ ID NO: 536 or a fragment thereof.

The disclosure also provides a self-replicating RNA molecule comprising an RNA encoding the polypeptide of SEQ ID NO: 169 or a fragment thereof. In some embodiments, the self-replicating RNA molecule comprises an RNA corresponding to the polynucleotide of SEQ ID NO: 170 or a fragment thereof.

The disclosure also provides a self-replicating RNA molecule comprising an RNA encoding the polypeptide of SEQ ID NO: 171 or a fragment thereof. In some embodiments, the self-replicating RNA molecule comprises an RNA corresponding to the polynucleotide of SEQ ID NO: 172 or a fragment thereof. In some embodiments, the self-replicating RNA molecule comprises an RNA corresponding to the polynucleotide of SEQ ID NO: 496 or a fragment thereof. In some embodiments, the polypeptide of SEQ ID NO: 171, or a fragment thereof, is encoded by the polynucleotide of SEQ ID NO: 537 or a fragment thereof.

The disclosure also provides a self-replicating RNA molecule comprising an RNA encoding the polypeptide of SEQ ID NO: 173 or a fragment thereof. In some embodiments, the self-replicating RNA molecule comprises an RNA corresponding to the polynucleotide of SEQ ID NO: 174 or a fragment thereof.

The disclosure also provides a self-replicating RNA molecule comprising an RNA encoding the polypeptide of SEQ ID NO: 175 or a fragment thereof. In some embodiments, the self-replicating RNA molecule comprises an RNA corresponding to the polynucleotide of SEQ ID NO: 176 or a fragment thereof.

The disclosure also provides a self-replicating RNA molecule comprising an RNA encoding the polypeptide of SEQ ID NO: 177 or a fragment thereof. In some embodiments, the self-replicating RNA molecule comprises an RNA corresponding to the polynucleotide of SEQ ID NO: 178 or a fragment thereof. In some embodiments, the self-replicating RNA molecule comprises an RNA corresponding to the polynucleotide of SEQ ID NO: 499 or a fragment thereof. In some embodiments, the self-replicating RNA molecule comprises an RNA corresponding to the polynucleotide of SEQ ID NO: 540 or a fragment thereof.

The disclosure also provides a self-replicating RNA molecule comprising an RNA encoding the polypeptide of SEQ ID NO: 179 or a fragment thereof. In some embodiments, the self-replicating RNA molecule comprises an RNA corresponding to the polynucleotide of SEQ ID NO: 180 or a fragment thereof.

The disclosure also provides a self-replicating RNA molecule comprising an RNA encoding the polypeptide of SEQ ID NO: 181 or a fragment thereof. In some embodiments, the self-replicating RNA molecule comprises an RNA corresponding to the polynucleotide of SEQ ID NO: 182 or a fragment thereof.

The disclosure also provides a self-replicating RNA molecule comprising an RNA encoding the polypeptide of SEQ ID NO: 183 or a fragment thereof. In some embodiments, the self-replicating RNA molecule comprises an RNA corresponding to the polynucleotide of SEQ ID NO: 184 or a fragment thereof.

The disclosure also provides a self-replicating RNA molecule comprising an RNA encoding the polypeptide of SEQ ID NO: 185 or a fragment thereof. In some embodiments, the self-replicating RNA molecule comprises an RNA corresponding to the polynucleotide of SEQ ID NO: 186 or a fragment thereof.

The disclosure also provides a self-replicating RNA molecule comprising an RNA encoding the polypeptide of SEQ ID NO: 187 or a fragment thereof. In some embodiments, the self-replicating RNA molecule comprises an RNA corresponding to the polynucleotide of SEQ ID NO: 188 or a fragment thereof.

The disclosure also provides a self-replicating RNA molecule comprising an RNA encoding the polypeptide of SEQ ID NO: 189 or a fragment thereof. In some embodiments, the self-replicating RNA molecule comprises an RNA corresponding to the polynucleotide of SEQ ID NO: 190 or a fragment thereof.

The disclosure also provides a self-replicating RNA molecule comprising an RNA encoding the polypeptide of SEQ ID NO: 191 or a fragment thereof. In some embodiments, the self-replicating RNA molecule comprises an RNA corresponding to the polynucleotide of SEQ ID NO: 192 or a fragment thereof.

The disclosure also provides a self-replicating RNA molecule comprising an RNA encoding the polypeptide of SEQ ID NO: 193 or a fragment thereof. In some embodiments, the self-replicating RNA molecule comprises an RNA corresponding to the polynucleotide of SEQ ID NO: 194 or a fragment thereof.

The disclosure also provides a self-replicating RNA molecule comprising an RNA encoding the polypeptide of SEQ ID NO: 195 or a fragment thereof. In some embodiments, the self-replicating RNA molecule comprises an RNA corresponding to the polynucleotide of SEQ ID NO: 196 or a fragment thereof.

The disclosure also provides a self-replicating RNA molecule comprising an RNA encoding the polypeptide of SEQ ID NO: 197 or a fragment thereof. In some embodiments, the self-replicating RNA molecule comprises an RNA corresponding to the polynucleotide of SEQ ID NO: 198 or a fragment thereof.

The disclosure also provides a self-replicating RNA molecule comprising an RNA encoding the polypeptide of SEQ ID NO: 199 or a fragment thereof. In some embodiments, the self-replicating RNA molecule comprises an RNA corresponding to the polynucleotide of SEQ ID NO: 200 or a fragment thereof.

The disclosure also provides a self-replicating RNA molecule comprising an RNA encoding the polypeptide of SEQ ID NO: 201 or a fragment thereof. In some embodiments, the self-replicating RNA molecule comprises an RNA corresponding to the polynucleotide of SEQ ID NO: 202 or a fragment thereof.

The disclosure also provides a self-replicating RNA molecule comprising an RNA encoding the polypeptide of SEQ ID NO: 203 or a fragment thereof. In some embodiments, the self-replicating RNA molecule comprises an RNA corresponding to the polynucleotide of SEQ ID NO: 204 or a fragment thereof.

The disclosure also provides a self-replicating RNA molecule comprising an RNA encoding the polypeptide of SEQ ID NO: 205 or a fragment thereof. In some embodiments, the self-replicating RNA molecule comprises an RNA corresponding to the polynucleotide of SEQ ID NO: 206 or a fragment thereof.

The disclosure also provides a self-replicating RNA molecule comprising an RNA encoding the polypeptide of SEQ ID NO: 207 or a fragment thereof. In some embodiments, the self-replicating RNA molecule comprises an RNA corresponding to the polynucleotide of SEQ ID NO: 208 or a fragment thereof.

The disclosure also provides a self-replicating RNA molecule comprising an RNA encoding the polypeptide of SEQ ID NO: 209 or a fragment thereof. In some embodiments, the self-replicating RNA molecule comprises an RNA corresponding to the polynucleotide of SEQ ID NO: 210 or a fragment thereof.

The disclosure also provides a self-replicating RNA molecule comprising an RNA encoding the polypeptide of SEQ ID NO: 211 or a fragment thereof. In some embodiments, the self-replicating RNA molecule comprises an RNA corresponding to the polynucleotide of SEQ ID NO: 212 or a fragment thereof. In some embodiments, the self-replicating RNA molecule comprises an RNA corresponding to the polynucleotide of SEQ ID NO: 484 or a fragment thereof. In some embodiments, the self-replicating RNA molecule comprises an RNA corresponding to the polynucleotide of SEQ ID NO: 525 or a fragment thereof.

The disclosure also provides a self-replicating RNA molecule comprising an RNA encoding the polypeptide of SEQ ID NO: 213 or a fragment thereof. In some embodiments, the self-replicating RNA molecule comprises an RNA corresponding to the polynucleotide of SEQ ID NO: 214 or a fragment thereof. In some embodiments, the self-replicating RNA molecule comprises an RNA corresponding to the polynucleotide of SEQ ID NO: 486 or a fragment thereof.

The disclosure also provides a self-replicating RNA molecule comprising an RNA encoding the polypeptide of SEQ ID NO: 215 or a fragment thereof. In some embodiments, the self-replicating RNA molecule comprises an RNA corresponding to the polynucleotide of SEQ ID NO: 216 or a fragment thereof. In some embodiments, the self-replicating RNA molecule comprises an RNA corresponding to the polynucleotide of SEQ ID NO: 487 or a fragment thereof. In some the self-replicating RNA molecule comprises an RNA corresponding to the polynucleotide of SEQ ID NO: 528 or a fragment thereof.

The disclosure also provides a self-replicating RNA molecule comprising an RNA encoding the polypeptide of SEQ ID NO: 217 or a fragment thereof. In some embodiments, the self-replicating RNA molecule comprises an RNA corresponding to the polynucleotide of SEQ ID NO: 218 or a fragment thereof.

The disclosure also provides a self-replicating RNA molecule comprising an RNA encoding the polypeptide of SEQ ID NO: 219 or a fragment thereof. In some embodiments, the self-replicating RNA molecule comprises an RNA corresponding to the polynucleotide of SEQ ID NO: 220 or a fragment thereof. In some embodiments, the self-replicating RNA molecule comprises an RNA corresponding to the polynucleotide of SEQ ID NO: 489 or a fragment thereof. In some embodiments, the polypeptide of SEQ ID NO: 219, or a fragment thereof, is encoded by the polynucleotide of SEQ ID NO: 530 or a fragment thereof.

The disclosure also provides a self-replicating RNA molecule comprising an RNA encoding the polypeptide of SEQ ID NO: 221 or a fragment thereof. In some embodiments, the self-replicating RNA molecule comprises an RNA corresponding to the polynucleotide of SEQ ID NO: 222 or a fragment thereof. In some embodiments, the self-replicating RNA molecule comprises an RNA corresponding to the polynucleotide of SEQ ID NO: 488 or a fragment thereof. In some embodiments, the self-replicating RNA molecule comprises an RNA corresponding to the polynucleotide of SEQ ID NO: 529 or a fragment thereof.

The disclosure also provides a self-replicating RNA molecule comprising an RNA encoding the polypeptide of SEQ ID NO: 223 or a fragment thereof. In some embodiments, the self-replicating RNA molecule comprises an RNA corresponding to the polynucleotide of SEQ ID NO: 224 or a fragment thereof. In some embodiments, the self-replicating RNA molecule comprises an RNA corresponding to the polynucleotide of SEQ ID NO: 494 or a fragment thereof. In some embodiments, self-replicating RNA molecule comprises an RNA corresponding to the polynucleotide of SEQ ID NO: 535 or a fragment thereof.

The disclosure also provides a self-replicating RNA molecule comprising an RNA encoding the polypeptide of SEQ ID NO: 225 or a fragment thereof. In some embodiments, the self-replicating RNA molecule comprises an RNA corresponding to the polynucleotide of SEQ ID NO: 226 or a fragment thereof. In some embodiments, the self-replicating RNA molecule comprises an RNA corresponding to the polynucleotide of SEQ ID NO: 490 or a fragment thereof. In some embodiments, the self-replicating RNA molecule comprises an RNA corresponding to the polynucleotide of SEQ ID NO: 531 or a fragment thereof.

The disclosure also provides a self-replicating RNA molecule comprising an RNA encoding the polypeptide of SEQ ID NO: 227 or a fragment thereof. In some embodiments, the self-replicating RNA molecule comprises an RNA corresponding to the polynucleotide of SEQ ID NO: 228 or a fragment thereof.

The disclosure also provides a self-replicating RNA molecule comprising an RNA encoding the polypeptide of SEQ ID NO: 229 or a fragment thereof. In some embodiments, the self-replicating RNA molecule comprises an RNA corresponding to the polynucleotide of SEQ ID NO: 230 or a fragment thereof.

The disclosure also provides a self-replicating RNA molecule comprising an RNA encoding the polypeptide of SEQ ID NO: 231 or a fragment thereof. In some embodiments, the self-replicating RNA molecule comprises an RNA corresponding to the polynucleotide of SEQ ID NO: 232 or a fragment thereof.

The disclosure also provides a self-replicating RNA molecule comprising an RNA encoding the polypeptide of SEQ ID NO: 233 or a fragment thereof. In some embodiments, the self-replicating RNA molecule comprises an RNA corresponding to the polynucleotide of SEQ ID NO: 234 or a fragment thereof.

The disclosure also provides a self-replicating RNA molecule comprising an RNA encoding the polypeptide of SEQ ID NO: 235 or a fragment thereof. In some embodiments, the self-replicating RNA molecule comprises an RNA corresponding to the polynucleotide of SEQ ID NO: 236 or a fragment thereof. In some embodiments, the self-replicating RNA molecule comprises an RNA corresponding to the polynucleotide of SEQ ID NO: 493 or a fragment thereof. In some embodiments, the self-replicating RNA molecule comprises an RNA corresponding to the polynucleotide of SEQ ID NO: 534 or a fragment thereof.

The disclosure also provides a self-replicating RNA molecule comprising an RNA encoding the polypeptide of SEQ ID NO: 237 or a fragment thereof. In some embodiments, the self-replicating RNA molecule comprises an RNA corresponding to the polynucleotide of SEQ ID NO: 238 or a fragment thereof.

The disclosure also provides a self-replicating RNA molecule comprising an RNA encoding the polypeptide of SEQ ID NO: 239 or a fragment thereof. In some embodiments, the self-replicating RNA molecule comprises an RNA corresponding to the polynucleotide of SEQ ID NO: 240 or a fragment thereof.

The disclosure also provides a self-replicating RNA molecule comprising an RNA encoding the polypeptide of SEQ ID NO: 241 or a fragment thereof. In some embodiments, the self-replicating RNA molecule comprises an RNA corresponding to the polynucleotide of SEQ ID NO: 242 or a fragment thereof.

The disclosure also provides a self-replicating RNA molecule comprising an RNA encoding the polypeptide of SEQ ID NO: 243 or a fragment thereof. In some embodiments, the self-replicating RNA molecule comprises an RNA corresponding to the polynucleotide of SEQ ID NO: 244 or a fragment thereof.

The disclosure also provides a self-replicating RNA molecule comprising an RNA encoding the polypeptide of SEQ ID NO: 245 or a fragment thereof. In some embodiments, the self-replicating RNA molecule comprises an RNA corresponding to the polynucleotide of SEQ ID NO: 246 or a fragment thereof. In some embodiments, the self-replicating RNA molecule comprises an RNA corresponding to the polynucleotide of SEQ ID NO: 470 or a fragment thereof. In some embodiments, the self-replicating RNA molecule comprises an RNA corresponding to the polynucleotide of SEQ ID NO: 511 or a fragment thereof.

The disclosure also provides a self-replicating RNA molecule comprising an RNA encoding the polypeptide of SEQ ID NO: 247 or a fragment thereof. In some embodiments, the self-replicating RNA molecule comprises an RNA corresponding to the polynucleotide of SEQ ID NO: 248 or a fragment thereof.

The disclosure also provides a self-replicating RNA molecule comprising an RNA encoding the polypeptide of SEQ ID NO: 249 or a fragment thereof. In some embodiments, the self-replicating RNA molecule comprises an RNA corresponding to the polynucleotide of SEQ ID NO: 250 or a fragment thereof.

The disclosure also provides a self-replicating RNA molecule comprising an RNA encoding the polypeptide of SEQ ID NO: 251 or a fragment thereof. In some embodiments, the self-replicating RNA molecule comprises an RNA corresponding to the polynucleotide of SEQ ID NO: 252 or a fragment thereof. In some embodiments, the self-replicating RNA molecule comprises an RNA corresponding to the polynucleotide of SEQ ID NO: 469 or a fragment thereof. In some embodiments, the self-replicating RNA molecule comprises an RNA corresponding to the polynucleotide of SEQ ID NO: 510 or a fragment thereof.

The disclosure also provides a self-replicating RNA molecule comprising an RNA encoding the polypeptide of SEQ ID NO: 253 or a fragment thereof. In some embodiments, the self-replicating RNA molecule comprises an RNA corresponding to the polynucleotide of SEQ ID NO: 254 or a fragment thereof. In some embodiments, the self-replicating RNA molecule comprises an RNA corresponding to the polynucleotide of SEQ ID NO: 464 or a fragment thereof. In some embodiments, the self-replicating RNA molecule comprises an RNA corresponding to the polynucleotide of SEQ ID NO: 505 or a fragment thereof.

The disclosure also provides a self-replicating RNA molecule comprising an RNA encoding the polypeptide of SEQ ID NO: 255 or a fragment thereof. In some embodiments, the self-replicating RNA molecule comprises an RNA corresponding to the polynucleotide of SEQ ID NO: 256 or a fragment thereof. In some embodiments, the self-replicating RNA molecule comprises an RNA corresponding to the polynucleotide of SEQ ID NO: 474 or a fragment thereof. In some embodiments, the self-replicating RNA molecule comprises an RNA corresponding to the polynucleotide of SEQ ID NO: 515 or a fragment thereof.

The disclosure also provides a self-replicating RNA molecule comprising an RNA encoding the polypeptide of SEQ ID NO: 257 or a fragment thereof. In some embodiments, the self-replicating RNA molecule comprises an RNA corresponding to the polynucleotide of SEQ ID NO: 258 or a fragment thereof.

The disclosure also provides a self-replicating RNA molecule comprising an RNA encoding the polypeptide of SEQ ID NO: 259 or a fragment thereof. In some embodiments, the self-replicating RNA molecule comprises an RNA corresponding to the polynucleotide of SEQ ID NO: 260 or a fragment thereof.

The disclosure also provides a self-replicating RNA molecule comprising an RNA encoding the polypeptide of SEQ ID NO: 261 or a fragment thereof. In some embodiments, the self-replicating RNA molecule comprises an RNA corresponding to the polynucleotide of SEQ ID NO: 262 or a fragment thereof. In some embodiments, the self-replicating RNA molecule comprises an RNA corresponding to the polynucleotide of SEQ ID NO: 471 or a fragment thereof. In some embodiments, the self-replicating RNA molecule comprises an RNA corresponding to the polynucleotide of SEQ ID NO: 512 or a fragment thereof.

The disclosure also provides a self-replicating RNA molecule comprising an RNA encoding the polypeptide of SEQ ID NO: 263 or a fragment thereof. In some embodiments, the self-replicating RNA molecule comprises an RNA corresponding to the polynucleotide of SEQ ID NO: 264 or a fragment thereof.

The disclosure also provides a self-replicating RNA molecule comprising an RNA encoding the polypeptide of SEQ ID NO: 265 or a fragment thereof. In some embodiments, the self-replicating RNA molecule comprises an RNA corresponding to the polynucleotide of SEQ ID NO: 266 or a fragment thereof. In some embodiments, the self-replicating RNA molecule comprises an RNA corresponding to the polynucleotide of SEQ ID NO: 472 or a fragment thereof. In some embodiments, the self-replicating RNA molecule comprises an RNA corresponding to the polynucleotide of SEQ ID NO: 513 or a fragment thereof.

The disclosure also provides a self-replicating RNA molecule comprising an RNA encoding the polypeptide of SEQ ID NO: 267 or a fragment thereof. In some embodiments, the self-replicating RNA molecule comprises an RNA corresponding to the polynucleotide of SEQ ID NO: 268 or a fragment thereof.

The disclosure also provides a self-replicating RNA molecule comprising an RNA encoding the polypeptide of SEQ ID NO: 269 or a fragment thereof. In some embodiments, the self-replicating RNA molecule comprises an RNA corresponding to the polynucleotide of SEQ ID NO: 270 or a fragment thereof. In some embodiments, the self-replicating RNA molecule comprises an RNA corresponding to the polynucleotide of SEQ ID NO: 463 or a fragment thereof. In some embodiments, the self-replicating RNA molecule comprises an RNA corresponding to the polynucleotide of SEQ ID NO: 504 or a fragment thereof.

The disclosure also provides a self-replicating RNA molecule comprising an RNA encoding the polypeptide of SEQ ID NO: 271 or a fragment thereof. In some embodiments, the self-replicating RNA molecule comprises an RNA corresponding to the polynucleotide of SEQ ID NO: 272 or a fragment thereof. In some embodiments, the self-replicating RNA molecule comprises an RNA corresponding to the polynucleotide of SEQ ID NO: 465 or a fragment thereof. In some embodiments, the self-replicating RNA molecule comprises an RNA corresponding to the polynucleotide of SEQ ID NO: 508 or a fragment thereof.

The disclosure also provides a self-replicating RNA molecule comprising an RNA encoding the polypeptide of SEQ ID NO: 273 or a fragment thereof. In some embodiments, the self-replicating RNA molecule comprises an RNA corresponding to the polynucleotide of SEQ ID NO: 274 or a fragment thereof.

The disclosure also provides a self-replicating RNA molecule comprising an RNA encoding the polypeptide of SEQ ID NO: 275 or a fragment thereof. In some embodiments, the self-replicating RNA molecule comprises an RNA corresponding to the polynucleotide of SEQ ID NO: 276 or a fragment thereof. In some embodiments, the self-replicating RNA molecule comprises an RNA corresponding to the polynucleotide of SEQ ID NO: 459 or a fragment thereof. In some embodiments, the self-replicating RNA molecule comprises an RNA corresponding to the polynucleotide of SEQ ID NO: 500 or a fragment thereof.

The disclosure also provides a self-replicating RNA molecule comprising an RNA encoding the polypeptide of SEQ ID NO: 277 or a fragment thereof. In some embodiments, the self-replicating RNA molecule comprises an RNA corresponding to the polynucleotide of SEQ ID NO: 278 or a fragment thereof. In some embodiments, the self-replicating RNA molecule comprises an RNA corresponding to the polynucleotide of SEQ ID NO: 475 or a fragment thereof. In some embodiments, the self-replicating RNA molecule comprises an RNA corresponding to the polynucleotide of SEQ ID NO: 516 or a fragment thereof.

The disclosure also provides a self-replicating RNA molecule comprising an RNA encoding the polypeptide of SEQ ID NO: 279 or a fragment thereof. In some embodiments, the self-replicating RNA molecule comprises an RNA corresponding to the polynucleotide of SEQ ID NO: 280 or a fragment thereof.

The disclosure also provides a self-replicating RNA molecule comprising an RNA encoding the polypeptide of SEQ ID NO: 281 or a fragment thereof. In some embodiments, the self-replicating RNA molecule comprises an RNA corresponding to the polynucleotide of SEQ ID NO: 282 or a fragment thereof.

The disclosure also provides a self-replicating RNA molecule comprising an RNA encoding the polypeptide of SEQ ID NO: 283 or a fragment thereof. In some embodiments, the self-replicating RNA molecule comprises an RNA corresponding to the polynucleotide of SEQ ID NO: 284 or a fragment thereof.

The disclosure also provides a self-replicating RNA molecule comprising an RNA encoding the polypeptide of SEQ ID NO: 285 or a fragment thereof. In some embodiments, the self-replicating RNA molecule comprises an RNA corresponding to the polynucleotide of SEQ ID NO: 286 or a fragment thereof. In some embodiments, the polypeptide of SEQ ID NO: 285, or a fragment thereof, is encoded by the polynucleotide of SEQ ID NO: 477 or a fragment thereof.

The disclosure also provides a self-replicating RNA molecule comprising an RNA encoding the polypeptide of SEQ ID NO: 287 or a fragment thereof. In some embodiments, the self-replicating RNA molecule comprises an RNA corresponding to the polynucleotide of SEQ ID NO: 288 or a fragment thereof.

The disclosure also provides a self-replicating RNA molecule comprising an RNA encoding the polypeptide of SEQ ID NO: 289 or a fragment thereof. In some embodiments, the self-replicating RNA molecule comprises an RNA corresponding to the polynucleotide of SEQ ID NO: 290 or a fragment thereof.

The disclosure also provides a self-replicating RNA molecule comprising an RNA encoding the polypeptide of SEQ ID NO: 291 or a fragment thereof. In some embodiments, the self-replicating RNA molecule comprises an RNA corresponding to the polynucleotide of SEQ ID NO: 292 or a fragment thereof.

The disclosure also provides a self-replicating RNA molecule comprising an RNA encoding the polypeptide of SEQ ID NO: 293 or a fragment thereof. In some embodiments, the self-replicating RNA molecule comprises an RNA corresponding to the polynucleotide of SEQ ID NO: 294 or a fragment thereof.

The disclosure also provides a self-replicating RNA molecule comprising an RNA encoding the polypeptide of SEQ ID NO: 295 or a fragment thereof. In some embodiments, the self-replicating RNA molecule comprises an RNA corresponding to the polynucleotide of SEQ ID NO: 296 or a fragment thereof.

The disclosure also provides a self-replicating RNA molecule comprising an RNA encoding the polypeptide of SEQ ID NO: 297 or a fragment thereof. In some embodiments, the self-replicating RNA molecule comprises an RNA corresponding to the polynucleotide of SEQ ID NO: 298 or a fragment thereof. In some embodiments, the self-replicating RNA molecule comprises an RNA corresponding to the polynucleotide of SEQ ID NO: 476 or a fragment thereof. In some embodiments, the self-replicating RNA molecule comprises an RNA corresponding to the polynucleotide of SEQ ID NO: 517 or a fragment thereof.

The disclosure also provides a self-replicating RNA molecule comprising an RNA encoding the polypeptide of SEQ ID NO: 299 or a fragment thereof. In some embodiments, the self-replicating RNA molecule comprises an RNA corresponding to the polynucleotide of SEQ ID NO: 300 or a fragment thereof.

The disclosure also provides a self-replicating RNA molecule comprising an RNA encoding the polypeptide of SEQ ID NO: 301 or a fragment thereof. In some embodiments, the self-replicating RNA molecule comprises an RNA corresponding to the polynucleotide of SEQ ID NO: 302 or a fragment thereof.

The disclosure also provides a self-replicating RNA molecule comprising an RNA encoding the polypeptide of SEQ ID NO: 303 or a fragment thereof. In some embodiments, the self-replicating RNA molecule comprises an RNA corresponding to the polynucleotide of SEQ ID NO: 304 or a fragment thereof.

The disclosure also provides a self-replicating RNA molecule comprising an RNA encoding the polypeptide of SEQ ID NO: 305 or a fragment thereof. In some embodiments, the self-replicating RNA molecule comprises an RNA corresponding to the polynucleotide of SEQ ID NO: 306 or a fragment thereof. In some embodiments, the self-replicating RNA molecule comprises an RNA corresponding to the polynucleotide of SEQ ID NO: 468 or a fragment thereof. In some embodiments, the self-replicating RNA molecule comprises an RNA corresponding to the polynucleotide of SEQ ID NO: 509 or a fragment thereof.

The disclosure also provides a self-replicating RNA molecule comprising an RNA encoding the polypeptide of SEQ ID NO: 307 or a fragment thereof. In some embodiments, the self-replicating RNA molecule comprises an RNA corresponding to the polynucleotide of SEQ ID NO: 308 or a fragment thereof.

The disclosure also provides a self-replicating RNA molecule comprising an RNA encoding the polypeptide of SEQ ID NO: 309 or a fragment thereof. In some embodiments, the self-replicating RNA molecule comprises an RNA corresponding to the polynucleotide of SEQ ID NO: 310 or a fragment thereof. In some embodiments, the self-replicating RNA molecule comprises an RNA corresponding to the polynucleotide of SEQ ID NO: 465 or a fragment thereof. In some embodiments, the self-replicating RNA molecule comprises an RNA corresponding to the polynucleotide of SEQ ID NO: 506 or a fragment thereof.

The disclosure also provides a self-replicating RNA molecule comprising an RNA encoding the polypeptide of SEQ ID NO: 311 or a fragment thereof. In some embodiments, the self-replicating RNA molecule comprises an RNA corresponding to the polynucleotide of SEQ ID NO: 312 or a fragment thereof.

The disclosure also provides a self-replicating RNA molecule comprising an RNA encoding the polypeptide of SEQ ID NO: 313 or a fragment thereof. In some embodiments, the self-replicating RNA molecule comprises an RNA corresponding to the polynucleotide of SEQ ID NO: 314 or a fragment thereof.

The disclosure also provides a self-replicating RNA molecule comprising an RNA encoding the polypeptide of SEQ ID NO: 315 or a fragment thereof. In some embodiments, the self-replicating RNA molecule comprises an RNA corresponding to the polynucleotide of SEQ ID NO: 316 or a fragment thereof.

The disclosure also provides a self-replicating RNA molecule comprising an RNA encoding the polypeptide of SEQ ID NO: 317 or a fragment thereof. In some embodiments, the self-replicating RNA molecule comprises an RNA corresponding to the polynucleotide of SEQ ID NO: 318 or a fragment thereof. In some embodiments, the self-replicating RNA molecule comprises an RNA corresponding to the polynucleotide of SEQ ID NO: 473 or a fragment thereof. In some embodiments, the self-replicating RNA molecule comprises an RNA corresponding to the polynucleotide of SEQ ID NO: 514 or a fragment thereof.

The disclosure also provides a self-replicating RNA molecule comprising an RNA encoding the polypeptide of SEQ ID NO: 319 or a fragment thereof. In some embodiments, the self-replicating RNA molecule comprises an RNA corresponding to the polynucleotide of SEQ ID NO: 320 or a fragment thereof.

The disclosure also provides a self-replicating RNA molecule comprising an RNA encoding the polypeptide of SEQ ID NO: 321 or a fragment thereof. In some embodiments, the self-replicating RNA molecule comprises an RNA corresponding to the polynucleotide of SEQ ID NO: 322 or a fragment thereof.

The disclosure also provides a self-replicating RNA molecule comprising an RNA encoding the polypeptide of SEQ ID NO: 323 or a fragment thereof. In some embodiments, the self-replicating RNA molecule comprises an RNA corresponding to the polynucleotide of SEQ ID NO: 324 or a fragment thereof.

The disclosure also provides a self-replicating RNA molecule comprising an RNA encoding the polypeptide of SEQ ID NO: 325 or a fragment thereof. In some embodiments, the self-replicating RNA molecule comprises an RNA corresponding to the polynucleotide of SEQ ID NO: 326 or a fragment thereof. In some embodiments, the self-replicating RNA molecule comprises an RNA corresponding to the polynucleotide of SEQ ID NO: 466 or a fragment thereof. In some embodiments, the self-replicating RNA molecule comprises an RNA corresponding to the polynucleotide of SEQ ID NO: 507 or a fragment thereof.

The disclosure also provides a self-replicating RNA molecule comprising an RNA encoding the polypeptide of SEQ ID NO: 327 or a fragment thereof. In some embodiments, the self-replicating RNA molecule comprises an RNA corresponding to the polynucleotide of SEQ ID NO: 328 or a fragment thereof.

The disclosure also provides a self-replicating RNA molecule comprising an RNA encoding the polypeptide of SEQ ID NO: 329 or a fragment thereof. In some embodiments, the self-replicating RNA molecule comprises an RNA corresponding to the polynucleotide of SEQ ID NO: 330 or a fragment thereof.

The disclosure also provides a self-replicating RNA molecule comprising an RNA encoding the polypeptide of SEQ ID NO: 331 or a fragment thereof. In some embodiments, the self-replicating RNA molecule comprises an RNA corresponding to the polynucleotide of SEQ ID NO: 332 or a fragment thereof.

The disclosure also provides a self-replicating RNA molecule comprising an RNA encoding the polypeptide of SEQ ID NO: 333 or a fragment thereof. In some embodiments, the self-replicating RNA molecule comprises an RNA corresponding to the polynucleotide of SEQ ID NO: 334 or a fragment thereof. In some embodiments, the self-replicating RNA molecule comprises an RNA corresponding to the polynucleotide of SEQ ID NO: 461 or a fragment thereof.

The disclosure also provides a self-replicating RNA molecule comprising an RNA encoding the polypeptide of SEQ ID NO: 335 or a fragment thereof. In some embodiments, the self-replicating RNA molecule comprises an RNA corresponding to the polynucleotide of SEQ ID NO: 336 or a fragment thereof.

The disclosure also provides a self-replicating RNA molecule comprising an RNA encoding the polypeptide of SEQ ID NO: 337 or a fragment thereof. In some embodiments, the self-replicating RNA molecule comprises an RNA corresponding to the polynucleotide of SEQ ID NO: 338 or a fragment thereof. In some embodiments, the self-replicating RNA molecule comprises an RNA corresponding to the polynucleotide of SEQ ID NO: 462 or a fragment thereof. In some embodiments, the self-replicating RNA molecule comprises an RNA corresponding to the polynucleotide of SEQ ID NO: 503 or a fragment thereof.

The disclosure also provides a self-replicating RNA molecule comprising an RNA encoding the polypeptide of SEQ ID NO: 339 or a fragment thereof. In some embodiments, the self-replicating RNA molecule comprises an RNA corresponding to the polynucleotide of SEQ ID NO: 340 or a fragment thereof.

The disclosure also provides a self-replicating RNA molecule comprising an RNA encoding the polypeptide of SEQ ID NO: 341 or a fragment thereof. In some embodiments, the self-replicating RNA molecule comprises an RNA corresponding to the polynucleotide of SEQ ID NO: 342 or a fragment thereof.

The disclosure also provides a self-replicating RNA molecule comprising an RNA encoding the polypeptide of SEQ ID NO: 343 or a fragment thereof. In some embodiments, the self-replicating RNA molecule comprises an RNA corresponding to the polynucleotide of SEQ ID NO: 344 or a fragment thereof. In some embodiments, the self-replicating RNA molecule comprises an RNA corresponding to SEQ ID NO: 483 or a fragment thereof. In some embodiments, the self-replicating RNA molecule comprises an RNA corresponding to the polynucleotide of SEQ ID NO: 524 or a fragment thereof.

The disclosure also provides a self-replicating RNA molecule comprising an RNA encoding the polypeptide of SEQ ID NO: 345 or a fragment thereof. In some embodiments, the self-replicating RNA molecule comprises an RNA corresponding to the polynucleotide of SEQ ID NO: 346 or a fragment thereof. In some embodiments, the self-replicating RNA molecule comprises an RNA corresponding to the polynucleotide of SEQ ID NO: 491 or a fragment thereof. In some embodiments, the self-replicating RNA molecule comprises an RNA corresponding to the polynucleotide of SEQ ID NO: 532 or a fragment thereof.

The disclosure also provides a self-replicating RNA molecule comprising an RNA encoding the polypeptide of SEQ ID NO: 347 or a fragment thereof. In some embodiments, the self-replicating RNA molecule comprises an RNA corresponding to the polynucleotide of SEQ ID NO: 348 or a fragment thereof.

The disclosure also provides a self-replicating RNA molecule comprising an RNA encoding the polypeptide of SEQ ID NO: 349 or a fragment thereof. In some embodiments, the self-replicating RNA molecule comprises an RNA corresponding to the polynucleotide of SEQ ID NO: 350 or a fragment thereof. In some embodiments, the self-replicating RNA molecule comprises an RNA corresponding to the polynucleotide of SEQ ID NO: 485 or a fragment thereof.

The disclosure also provides a self-replicating RNA molecule comprising an RNA encoding the polypeptide of SEQ ID NO: 351 or a fragment thereof. In some embodiments, the self-replicating RNA molecule comprises an RNA corresponding to the polynucleotide of SEQ ID NO: 352 or a fragment thereof.

The disclosure also provides a self-replicating RNA molecule comprising an RNA encoding the polypeptide of SEQ ID NO: 353 or a fragment thereof. In some embodiments, the self-replicating RNA molecule comprises an RNA corresponding to the polynucleotide of SEQ ID NO: 354 or a fragment thereof. In some embodiments, the self-replicating RNA molecule comprises an RNA corresponding to the polynucleotide of SEQ ID NO: 492 or a fragment thereof. In some embodiments, the self-replicating RNA molecule comprises an RNA corresponding to the polynucleotide of SEQ ID NO: 533 or a fragment thereof.

The disclosure also provides a self-replicating RNA molecule comprising an RNA encoding the polypeptide of SEQ ID NO: 355 or a fragment thereof. In some embodiments, the self-replicating RNA molecule comprises an RNA corresponding to the polynucleotide of SEQ ID NO: 356 or a fragment thereof.

The disclosure also provides a self-replicating RNA molecule comprising an RNA encoding the polypeptide of SEQ ID NO: 357 or a fragment thereof. In some embodiments, the self-replicating RNA molecule comprises an RNA corresponding to the polynucleotide of SEQ ID NO: 358 or a fragment thereof.

The disclosure also provides a self-replicating RNA molecule comprising an RNA encoding the polypeptide of SEQ ID NO: 359 or a fragment thereof. In some embodiments, the self-replicating RNA molecule comprises an RNA corresponding to the polynucleotide of SEQ ID NO: 360 or a fragment thereof.

The disclosure also provides a self-replicating RNA molecule comprising an RNA encoding the polypeptide of SEQ ID NO: 361 or a fragment thereof. In some embodiments, the self-replicating RNA molecule comprises an RNA corresponding to the polynucleotide of SEQ ID NO: 362 or a fragment thereof.

The disclosure also provides a self-replicating RNA molecule comprising an RNA encoding the polypeptide of SEQ ID NO: 363 or a fragment thereof. In some embodiments, the self-replicating RNA molecule comprises an RNA corresponding to the polynucleotide of SEQ ID NO: 364 or a fragment thereof.

The disclosure also provides a self-replicating RNA molecule comprising an RNA encoding the polypeptide of SEQ ID NO: 365 or a fragment thereof. In some embodiments, the self-replicating RNA molecule comprises an RNA corresponding to the polynucleotide of SEQ ID NO: 366 or a fragment thereof.

The disclosure also provides a self-replicating RNA molecule comprising an RNA encoding the polypeptide of SEQ ID NO: 367 or a fragment thereof. In some embodiments, the self-replicating RNA molecule comprises an RNA corresponding to the polynucleotide of SEQ ID NO: 368 or a fragment thereof.

The disclosure also provides a self-replicating RNA molecule comprising an RNA encoding the polypeptide of SEQ ID NO: 369 or a fragment thereof. In some embodiments, the self-replicating RNA molecule comprises an RNA corresponding to the polynucleotide of SEQ ID NO: 370 or a fragment thereof.

The disclosure also provides a self-replicating RNA molecule comprising an RNA encoding the polypeptide of SEQ ID NO: 371 or a fragment thereof. In some embodiments, the self-replicating RNA molecule comprises an RNA corresponding to the polynucleotide of SEQ ID NO: 372 or a fragment thereof.

The disclosure also provides a self-replicating RNA molecule comprising an RNA encoding the polypeptide of SEQ ID NO: 373 or a fragment thereof. In some embodiments, the self-replicating RNA molecule comprises an RNA corresponding to the polynucleotide of SEQ ID NO: 374 or a fragment thereof.

The disclosure also provides a self-replicating RNA molecule comprising an RNA encoding the polypeptide of SEQ ID NO: 375 or a fragment thereof. In some embodiments, the self-replicating RNA molecule comprises an RNA corresponding to the polynucleotide of SEQ ID NO: 376 or a fragment thereof.

The disclosure also provides a self-replicating RNA molecule comprising an RNA encoding the polypeptide of SEQ ID NO: 379 or a fragment thereof. In some embodiments, the self-replicating RNA molecule comprises an RNA corresponding to the polynucleotide of SEQ ID NO: 380 or a fragment thereof. In some embodiments, the self-replicating RNA molecule comprises an RNA corresponding to the polynucleotide of SEQ ID NO: 482 or a fragment thereof. In some embodiments, the self-replicating RNA molecule comprises an RNA corresponding to the polynucleotide of SEQ ID NO: 523 or a fragment thereof.

The disclosure also provides a self-replicating RNA molecule comprising an RNA encoding the polypeptide of SEQ ID NO: 381 or a fragment thereof. In some embodiments, the self-replicating RNA molecule comprises an RNA corresponding to the polynucleotide of SEQ ID NO: 382 or a fragment thereof. In some embodiments, the self-replicating RNA molecule comprises an RNA corresponding to the polynucleotide of SEQ ID NO: 460 or a fragment thereof. In some embodiments, the self-replicating RNA molecule comprises an RNA corresponding to the polynucleotide of SEQ ID NO: 501 or a fragment thereof.

The disclosure also provides a self-replicating RNA molecule comprising an RNA encoding the polypeptide of SEQ ID NO: 383 or a fragment thereof. In some embodiments, the self-replicating RNA molecule comprises an RNA corresponding to the polynucleotide of SEQ ID NO: 384 or a fragment thereof.

The disclosure also provides a self-replicating RNA molecule comprising an RNA encoding the polypeptide of SEQ ID NO: 385 or a fragment thereof. In some embodiments, the self-replicating RNA molecule comprises an RNA corresponding to the polynucleotide of SEQ ID NO: 386 or a fragment thereof.

The disclosure also provides a self-replicating RNA molecule comprising an RNA encoding the polypeptide of SEQ ID NO: 387 or a fragment thereof.

The disclosure also provides a self-replicating RNA molecule comprising an RNA encoding the polypeptide of SEQ ID NO: 388 or a fragment thereof.

The disclosure also provides a self-replicating RNA molecule comprising an RNA encoding the polypeptide of SEQ ID NO: 389 or a fragment thereof.

The disclosure also provides a self-replicating RNA molecule comprising an RNA encoding the polypeptide of SEQ ID NO: 390 or a fragment thereof.

The disclosure also provides a self-replicating RNA molecule comprising an RNA encoding the polypeptide of SEQ ID NO: 391 or a fragment thereof.

The disclosure also provides a self-replicating RNA molecule comprising an RNA encoding the polypeptide of SEQ ID NO: 392 or a fragment thereof.

The disclosure also provides a self-replicating RNA molecule comprising an RNA encoding the polypeptide of SEQ ID NO: 393 or a fragment thereof.

The disclosure also provides a self-replicating RNA molecule comprising an RNA encoding the polypeptide of SEQ ID NO: 394 or a fragment thereof.

The disclosure also provides a self-replicating RNA molecule comprising an RNA encoding the polypeptide of SEQ ID NO: 395 or a fragment thereof.

The disclosure also provides a self-replicating RNA molecule comprising an RNA encoding the polypeptide of SEQ ID NO: 396 or a fragment thereof.

The disclosure also provides a self-replicating RNA molecule comprising an RNA encoding the polypeptide of SEQ ID NO: 397 or a fragment thereof.

The disclosure also provides a self-replicating RNA molecule comprising an RNA encoding the polypeptide of SEQ ID NO: 398 or a fragment thereof.

The disclosure also provides a self-replicating RNA molecule comprising an RNA encoding the polypeptide of SEQ ID NO: 399 or a fragment thereof.

The disclosure also provides a self-replicating RNA molecule comprising an RNA encoding the polypeptide of SEQ ID NO: 400 or a fragment thereof.

The disclosure also provides a self-replicating RNA molecule comprising an RNA encoding the polypeptide of SEQ ID NO: 401 or a fragment thereof.

The disclosure also provides a self-replicating RNA molecule comprising an RNA encoding the polypeptide of SEQ ID NO: 402 or a fragment thereof.

The disclosure also provides a self-replicating RNA molecule comprising an RNA encoding the polypeptide of SEQ ID NO: 403 or a fragment thereof.

The disclosure also provides a self-replicating RNA molecule comprising an RNA encoding the polypeptide of SEQ ID NO: 404 or a fragment thereof.

The disclosure also provides a self-replicating RNA molecule comprising an RNA encoding the polypeptide of SEQ ID NO: 405 or a fragment thereof.

The disclosure also provides a self-replicating RNA molecule comprising an RNA encoding the polypeptide of SEQ ID NO: 406 or a fragment thereof.

The disclosure also provides a self-replicating RNA molecule comprising an RNA encoding the polypeptide of SEQ ID NO: 407 or a fragment thereof.

The disclosure also provides a self-replicating RNA molecule comprising an RNA encoding the polypeptide of SEQ ID NO: 408 or a fragment thereof.

The disclosure also provides a self-replicating RNA molecule comprising an RNA encoding the polypeptide of SEQ ID NO: 426 or a fragment thereof.

The disclosure also provides a self-replicating RNA molecule comprising an RNA encoding the polypeptide of SEQ ID NO: 427 or a fragment thereof.

The disclosure also provides a self-replicating RNA molecule comprising an RNA encoding the polypeptide of SEQ ID NO: 428 or a fragment thereof.

The disclosure also provides a self-replicating RNA molecule comprising an RNA encoding the polypeptide of SEQ ID NO: 429 or a fragment thereof.

The disclosure also provides a self-replicating RNA molecule comprising an RNA encoding the polypeptide of SEQ ID NO: 430 or a fragment thereof.

The disclosure also provides a self-replicating RNA molecule comprising an RNA encoding the polypeptide of SEQ ID NO: 431 or a fragment thereof.

The disclosure also provides a self-replicating RNA molecule comprising an RNA encoding the polypeptide of SEQ ID NO: 432 or a fragment thereof.

The disclosure also provides a self-replicating RNA molecule comprising an RNA encoding the polypeptide of SEQ ID NO: 433 or a fragment thereof.

The disclosure also provides a self-replicating RNA molecule comprising an RNA encoding the polypeptide of SEQ ID NO: 434 or a fragment thereof.

The disclosure also provides a self-replicating RNA molecule comprising an RNA encoding the polypeptide of SEQ ID NO: 435 or a fragment thereof.

The disclosure also provides a self-replicating RNA molecule comprising an RNA encoding the polypeptide of SEQ ID NO: 436 or a fragment thereof.

The disclosure also provides a self-replicating RNA molecule comprising an RNA encoding the polypeptide of SEQ ID NO: 437 or a fragment thereof. In some embodiments, the self-replicating RNA molecule comprises an RNA corresponding to the polynucleotide of SEQ ID NO: 448 or a fragment thereof. In some embodiments, the self-replicating RNA molecule comprises an RNA corresponding to the polynucleotide of SEQ ID NO: 478 or a fragment thereof. In some embodiments, the self-replicating RNA molecule comprises an RNA corresponding to the polynucleotide of SEQ ID NO: 519 or a fragment thereof.

The disclosure also provides a self-replicating RNA molecule comprising an RNA encoding the polypeptide of SEQ ID NO: 438 or a fragment thereof. In some embodiments, the self-replicating RNA molecule comprises an RNA corresponding to the polynucleotide of SEQ ID NO: 449 or a fragment thereof.

The disclosure also provides a self-replicating RNA molecule comprising an RNA encoding the polypeptide of SEQ ID NO: 439 or a fragment thereof. In some embodiments, the self-replicating RNA molecule comprises an RNA corresponding to the polynucleotide of SEQ ID NO: 450 or a fragment thereof. In some embodiments, the self-replicating RNA molecule comprises an RNA corresponding to the polynucleotide of SEQ ID NO: 479 or a fragment thereof. In some embodiments, the self-replicating RNA molecule comprises an RNA corresponding to the polynucleotide of SEQ ID NO: 520 or a fragment thereof.

The disclosure also provides a self-replicating RNA molecule comprising an RNA encoding the polypeptide of SEQ ID NO: 440 or a fragment thereof. In some embodiments, the self-replicating RNA molecule comprises an RNA corresponding to the polynucleotide of SEQ ID NO: 451 or a fragment thereof.

The disclosure also provides a self-replicating RNA molecule comprising an RNA encoding the polypeptide of SEQ ID NO: 441 or a fragment thereof. In some embodiments, the self-replicating RNA molecule comprises an RNA corresponding to the polynucleotide of SEQ ID NO: 452 or a fragment thereof.

The disclosure also provides a self-replicating RNA molecule comprising an RNA encoding the polypeptide of SEQ ID NO: 442 or a fragment thereof. In some embodiments, the self-replicating RNA molecule comprises an RNA corresponding to the polynucleotide of SEQ ID NO: 453 or a fragment thereof. In some embodiments, the self-replicating RNA molecule comprises an RNA corresponding to the polynucleotide of SEQ ID NO: 480 or a fragment thereof. In some embodiments, the self-replicating RNA molecule comprises an RNA corresponding to the polynucleotide of SEQ ID NO: 521 or a fragment thereof.

The disclosure also provides a self-replicating RNA molecule comprising an RNA encoding the polypeptide of SEQ ID NO: 443 or a fragment thereof. In some embodiments, the self-replicating RNA molecule comprises an RNA corresponding to the polynucleotide of SEQ ID NO: 454 or a fragment thereof.

The disclosure also provides a self-replicating RNA molecule comprising an RNA encoding the polypeptide of SEQ ID NO: 444 or a fragment thereof. In some embodiments, the self-replicating RNA molecule comprises an RNA corresponding to the polynucleotide of SEQ ID NO: 455 or a fragment thereof. In some embodiments, the self-replicating RNA molecule comprises an RNA corresponding to the polynucleotide of SEQ ID NO: 481 or a fragment thereof. In some embodiments, the self-replicating RNA molecule comprises an RNA corresponding to the polynucleotide of SEQ ID NO: 522 or a fragment thereof.

The disclosure also provides a self-replicating RNA molecule comprising an RNA encoding the polypeptide of SEQ ID NO: 445 or a fragment thereof. In some embodiments, the self-replicating RNA molecule comprises an RNA corresponding to the polynucleotide of SEQ ID NO: 456 or a fragment thereof.

The disclosure also provides a self-replicating RNA molecule comprising an RNA encoding the polypeptide of SEQ ID NO: 446 or a fragment thereof. In some embodiments, the self-replicating RNA molecule comprises an RNA corresponding to the polynucleotide of SEQ ID NO: 457 or a fragment thereof.

The disclosure also provides a self-replicating RNA molecule comprising an RNA encoding the polypeptide of SEQ ID NO: 447 or a fragment thereof. In some embodiments, the self-replicating RNA molecule comprises an RNA corresponding to the polynucleotide of SEQ ID NO: 458 or a fragment thereof.

In some embodiments, the polynucleotide is an in-frame polynucleotide.

The self-replicating RNA molecule can comprise fragments of about 6-24 amino acids in length. In some embodiments, the self-replicating RNA molecule comprises fragments comprising at least 6 amino acids. In some embodiments, the fragments comprise at least 7 amino acids. In some embodiments, the fragments comprise at least 8 amino acids. In some embodiments, the fragments comprise at least 9 amino acids. In some embodiments, the fragments comprise at least 10 amino acids. In some embodiments, the fragments comprise at least 11 amino acids. In some embodiments, the fragments comprise at least 12 amino acids. In some embodiments, the fragments comprise at least 13 amino acids. In some embodiments, the fragments comprise at least 14 amino acids. In some embodiments, the fragments comprise at least 15 amino acids. In some embodiments, the fragments comprise at least 16 amino acids. In some embodiments, the fragments comprise at least 17 amino acids. In some embodiments, the fragments comprise at least 18 amino acids. In some embodiments, the fragments comprise at least 19 amino acids. In some embodiments, the fragments comprise at least 20 amino acids. In some embodiments, the fragments comprise at least 21 amino acids. In some embodiments, the fragments comprise at least 22 amino acids. In some embodiments, the fragments comprise at least 23 amino acids. In some embodiments, the fragments comprise at least 24 amino acids. In some embodiments, the fragments comprise at least 25 amino acids. In some embodiments, the fragments comprise about 6 amino acids. In some embodiments, the fragments comprise about 7 amino acids. In some embodiments, the fragments comprise about 8 amino acids. In some embodiments, the fragments comprise about 9 amino acids. In some embodiments, the fragments comprise about 10 amino acids. In some embodiments, the fragments comprise about 11 amino acids. In some embodiments, the fragments comprise about 12 amino acids. In some embodiments, the fragments comprise about 13 amino acids. In some embodiments, the fragments comprise about 14 amino acids. In some embodiments, the fragments comprise about 15 amino acids. In some embodiments, the fragments comprise about 16 amino acids. In some embodiments, the fragments comprise about 17 amino acids. In some embodiments, the fragments comprise about 18 amino acids. In some embodiments, the fragments comprise about 19 amino acids. In some embodiments, the fragments comprise about 20 amino acids. In some embodiments, the fragments comprise about 21 amino acids. In some embodiments, the fragments comprise about 22 amino acids. In some embodiments, the fragments comprise about 23 amino acids. In some embodiments, the fragments comprise about 24 amino acids. In some embodiments, the fragments comprise about 25 amino acids. In some embodiments, the fragments comprise about 6-25 amino acids. In some embodiments, the fragments comprise about 7-25 amino acids. In some embodiments, the fragments comprise about 8-25 amino acids. In some embodiments, the fragments comprise about 8-24 amino acids. In some embodiments, the fragments comprise about 8-23 amino acids. In some embodiments, the fragments comprise about 8-22 amino acids. In some embodiments, the fragments comprise about 8-21 amino acids. In some embodiments, the fragments comprise about 8-20 amino acids. In some embodiments, the fragments comprise about 8-19 amino acids. In some embodiments, the fragments comprise about 8-18 amino acids. In some embodiments, the fragments comprise about 8-17 amino acids. In some embodiments, the fragments comprise about 8-16 amino acids. In some embodiments, the fragments comprise about 8-15 amino acids. In some embodiments, the fragments comprise about 8-14 amino acids. In some embodiments, the fragments comprise about 9-14 amino acids. In some embodiments, the fragments comprise about 9-13 amino acids. In some embodiments, the fragments comprise about 9-12 amino acids. In some embodiments, the fragments comprise about 9-11 amino acids. In some embodiments, the fragments comprise about 9-10 amino acids.

The self-replicating RNA molecule can comprise RNA corresponding to fragments comprising SEQ ID NOs: 387, 388, 389, 390, 391, 392, 393, 394, 395, 396, 397, 398, 399, 400, 401, 402, 403, 404, 405, 406, 407, 408, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620 or 621.

The self-replicating RNA molecule can comprise RNA corresponding to fragments comprising SEQ ID NOs: 377, 378, 415, 417, 418, 420, 502, 518, 526, 527, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 74, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 487, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980 or 548.

The self-replicating RNA molecule can comprise fragments that are immunogenic fragments. Immunogenic fragments in general are peptides that activate T cells, for example those that induce cytotoxic T cells when presented on MHC. Methods for assessing activation of T cells and/or induction of cytotoxic T lymphocytes are well known. In an exemplary assay, PBMCs isolated from a prostate cancer patient are cultured in vitro in the presence of a test neoantigen or fragments thereof and IL-25. The cultures may be replenished periodically with IL-15 and IL-2 and cultured for an additional 12 days. On day 12, the cultures are re-stimulated with the test neoantigen or fragments thereof and the following day T cell activation may be assessed by measuring a percentage of $IFN\gamma^{+}TNA\alpha^{+}$ $CD8^{+}$ cells when compared to a control culture. In some embodiments, the fragments are about 6-25 amino acids in length, such as about 8-25 amino acids in length.

Any of the self-replicating RNA molecules disclosed herein can further comprise one or more of the following:

- one or more nonstructural genes nsP1, nsP2, nsP3, and nsP4;
- at least one of a DLP motif, a 5' UTR, a 3'UTR and a Poly A; and
- a subgenomic promoter.

In some embodiments, for example, the self-replicating RNA molecule can comprise:

- one or more of the following:
  - one or more nonstructural genes nsP1, nsP2, nsP3, and nsP4;
  - at least one of a DLP motif, a 5' UTR, a 3'UTR and a Poly A; and
  - a subgenomic promoter;
- and a RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof; operably linked to the subgenomic promoter.

In some embodiments, the self-replicating RNA molecule can comprise:

one or more of the following:

one or more nonstructural genes nsP1, nsP2, nsP3, and nsP4;

at least one of a DLP motif, 5' UTR, a 3'UTR and a Poly A; and a subgenomic promoter;

and a RNA encoding one or more polypeptides selected from the group consisting of SEQ ID NOs: 541, 543, 550, 552, 554, 555, 556, 557, 558, 559, 623, 624, 625, or 626. and fragments thereof; operably linked to the subgenomic promoter.

In some embodiments, the self-replicating RNA molecule comprises an RNA sub-sequence encoding a protein or peptide; 5' and 3' alphavirus untranslated regions; RNA sub-sequences encoding amino acid sequences derived from New World alphavirus VEEV nonstructural proteins nsP1, nsP2, nsP3, and nsP4; a sub-genomic promoter that is operably linked to and regulates translation of the RNA sequence encoding the protein; a 5' cap and a 3' poly-A tail; positive sense, single-stranded RNA; a DLP from Sindbis virus upstream of the non-structural protein 1 (nsP1); a 2A ribosome skipping element; and a nsp1 nucleotide repeat downstream of the 5'-UTR and upstream of the DLP.

Any of the self-replicating RNA molecules disclosed herein can further include a coding sequence for an autoprotease peptide (e.g., autocatalytic self-cleaving peptide), where the coding sequence for the autoprotease is optionally operably linked upstream to the second nucleic acid sequence. Generally, any proteolytic cleavage site known in the art can be incorporated into the nucleic acid molecules of the disclosure and can be, for example, proteolytic cleavage sequences that are cleaved post-production by a protease. Further suitable proteolytic cleavage sites also include proteolytic cleavage sequences that can be cleaved following addition of an external protease. As used herein the term "autoprotease" refers to a "self-cleaving" peptide that possesses autoproteolytic activity and is capable of cleaving itself from a larger polypeptide moiety. First identified in the foot-and-mouth disease virus (FMDV), a member of the picornavirus group, several autoproteases have been subsequently identified such as, for example, "2A like" peptides from equine rhinitis A virus (E2A), porcine teschovirus-1 (P2A) and Thosea asigna virus (T2A), and their activities in proteolytic cleavage have been shown in various ex vitro and in vivo eukaryotic systems. As such, the concept of autoproteases is available to one of skill in the art as many naturally-occurring autoprotease systems have been identified. Well studied autoprotease systems are e.g. viral proteases, developmental proteins (e.g. HetR, Hedgehog proteins), RumA autoprotease domain, UmuD, etc. Non-limiting examples of autoprotease peptides suitable for the compositions and methods of the present disclosure include the peptide sequences from porcine teschovirus-1 2A (P2A), a foot-and-mouth disease virus (FMDV) 2A (F2A), an Equine Rhinitis A Virus (ERAV) 2A (E2A), a Thosea asigna virus 2A (T2A), a cytoplasmic polyhedrosis virus 2A (BmCPV2A), a Flacherie Virus 2A (BmIFV2A), or a combination thereof.

In some embodiments, the coding sequence for the autoprotease peptide is operably linked downstream of the DLP motif and upstream to the first and second polynucleotides.

The autoprotease peptide can comprise, or consist of, a peptide sequence selected from the group consisting of porcine teschovirus-1 2A (P2A), a foot-and-mouth disease virus (FMDV) 2A (F2A), an Equine Rhinitis A Virus (ERAV) 2A (E2A), a Thosea asigna virus 2A (T2A), a cytoplasmic polyhedrosis virus 2A (BmCPV2A), a Flacherie Virus 2A (BmIFV2A), and a combination thereof. In some embodiments, the autoprotease peptide includes a peptide sequence of porcine teschovirus-1 2A (P2A).

In some embodiments, the autoprotease peptide is selected from the group consisting of porcine teschovirus-1 2A (P2A), foot-and-mouth disease virus (FMDV) 2A (F2A), Equine Rhinitis A Virus (ERAV) 2A (E2A), Thosea asigna virus 2A (T2A), cytoplasmic polyhedrosis virus 2A (BmCPV2A), Flacherie Virus 2A (BmIFV2A), and a combination thereof. In some embodiments, the autoprotease peptide is porcine teschovirus-1 2A (P2A). The incorporation of the P2A peptide in the modified viral RNA replicons of the present disclosure allows release of GOI protein (e.g. prostate neoantigens) from the capsid-GOI fusion.

The porcine teschovirus-1 2A (P2A) peptide sequence can be engineered in-frame immediately after the DLP sequence and in-frame immediately upstream of all GOI.

Any of the herein disclosed self-replicating RNA molecules can further include a coding sequence downstream Loop (DLP) motif. Some viruses have sequences capable of forming one or more stem-loop structures which regulate, for example increase, capsid gene expression. Viral capsid enhancer as used herein refers to a regulatory element comprising sequences capable of forming such stem-loop structures. In some examples, the stem-loop structures are formed by sequences within the coding sequence of a capsid protein and named Downstream Loop (DLP) sequence. As disclosed herein, these stem-loop structures or variants thereof can be used to regulate, for example increase, expression level of genes of interest. For example, these stem-loop structures or variants thereof can be used in a recombinant vector (e.g., in a heterologous viral genome) for enhancing transcription and/or translation of coding sequence operably linked downstream thereto.

Alphavirus replication in host cells is known to induce the double-stranded RNA-dependent protein kinase (PKR). PKR phosphorylates the eukaryotic translation initiation factor 2α (eIF2α). Phosphorylation of eIF2α blocks translation initiation of mRNA and in doing so keeps viruses from a completing a productive replication cycle. Infection of cells with Sindbis virus induces PKR that results in phosphorylation of eIF2α, yet the viral subgenomic mRNA is efficiently translated while translation of all other cellular mRNAs is restricted. The efficient translation of the viral subgenomic mRNA in Sindbis virus is made possible by the presence of a prominent RNA structure, a stable RNA hairpin loop located downstream of the wild type AUG initiator codon for the virus capsid protein (e.g., capsid enhancer). This hairpin loop, also called stem-loop, RNA structure is often referred to as the Downstream Loop structure (or DLP motif). It has been reported that the DLP structure can stall a ribosome on the wild type AUG and this supports translation of the subgenomic mRNA without the requirement for functional eIF2α. Thus, subgenomic mRNAs of Sindbis virus (SINV) as well as of other alphaviruses are efficiently translated even in cells that have highly active PKR resulting in complete phosphorylation of eIF2α.

The DLP structure was first characterized in Sindbis virus (SINV) 26S mRNA and also detected in Semliki Forest virus (SFV). Similar DLP structures have been reported to be present in at least 14 other members of the Alphavirus genus including New World (for example, MAYV, UNAV, EEEV (NA), EEEV (SA), AURAV) and Old World (SV, SFV, BEBV, RRV, SAG, GETV, MIDV, CHIKV, and ONNV)

members. The predicted structures of these Alphavirus 26S mRNAs were constructed based on SHAPE (selective 2'-hydroxyl acylation and primer extension) data (Toribio et al., Nucleic Acids Res. May 19; 44(9):4368-80, 2016, the content of which is hereby incorporated by reference). Stable stem-loop structures were detected in all cases except for CHIKV and ONNV, whereas MAYV and EEEV showed DLPs of lower stability (Toribio et al., 2016 supra). The highest DLP activities were reported for those Alphaviruses that contained the most stable DLP structures.

As an example, members of the Alphavirus genus can resist the activation of antiviral RNA-activated protein kinase (PKR) by means of the downstream loop (DLP) present within in viral 26S transcripts, which allows an eIF2-independent translation initiation of these mRNAs. The downstream loop (DLP), is located downstream from the AUG in SINV 26S mRNA and in other members of the Alphavirus genus.

In some embodiments, the self-replicating RNA molecules can include a coding sequence for a gene of interest (GOI) operably linked to DLP motif(s) and/or the coding sequence for the DLP motifs.

In some embodiments, the self-replicating RNA molecule of the disclosure comprises a downstream loop (DLP). In some embodiments, the downstream loop (DLP) comprises at least one RNA-stem-loop.

DLP activity can depend on the distance between the DLP motif and the initiation codon AUG (AUGi). The AUG-DLP spacing in Alphavirus 26S mRNAs is tuned to the topology of the ES6S region of the ribosomal 18S rRNA in a way that allows the placement of the AUGi in the P site of the 40S subunit stalled by the DLP, allowing the incorporation of Met-tRNA without the participation of eIF2. In the case of Sindbis virus, the DLP motif is found in the first ~150 nt of the Sindbis subgenomic RNA. The hairpin is located downstream of the Sindbis capsid AUG initiation codon (AUG at nt 50 of the Sindbis subgenomic RNA) and results in stalling a ribosome such that the correct capsid gene AUG is used to initiate translation. Previous studies of sequence comparisons and structural RNA analysis revealed the evolutionary conservation of DLP in SINV and predicted the existence of equivalent DLP structures in many members of the Alphavirus genus (see e.g., Ventoso, J. Virol. 9484-9494, Vol. 86, September 2012).

Without being bound by any particular theory, it is believed that placing the DLP motif upstream of a coding sequence for any GOI typically results in a fusion-protein of N-terminal capsid amino acids that are encoded in the hairpin region to the GOI encoded protein because initiation occurs on the capsid AUG not the GOI AUG.

In some embodiments, the self-replicating RNA molecule comprises a downstream loop placed upstream of the non-structural protein 1 (nsP1). In some embodiments, the downstream loop is placed upstream of the non-structural protein 1 (nsP1) and is joined to the nsP1 by a porcine teschovirus-1 2A (P2A) ribosome skipping element.

The DLP-containing self-replicating RNA molecule can be useful in conferring a resistance to the innate immune system in a subject. Unmodified RNA replicons are sensitive to the initial innate immune system state of cells they are introduced into. If the cells/individuals are in a highly active innate immune system state, the RNA replicon performance (e.g., replication and expression of a GOI) can be negatively impacted. By engineering a DLP to control initiation of protein translation, particularly of non-structural proteins, the impact of the pre-existing activation state of the innate immune system to influence efficient RNA replicon replication is removed or lessened. The result is more uniform and/or enhanced expression of a GOI that can impact vaccine efficacy or therapeutic impact of a treatment.

The DLP motif of the self-replicating RNA molecule can confer efficient mRNA translation in cellular environments where cellular mRNA translation is inhibited. When a DLP is linked with translation of a replicon vector's non-structural protein genes, the replicase and transcriptase proteins are capable of initiating functional replication in PKR activated cellular environments. When a DLP is linked with translation of subgenomic mRNAs, robust GOI expression is possible even when cellular mRNA is restricted due to innate immune activation. Accordingly, engineering self-replicating RNA that contain DLP structures to help drive translation of both non-structural protein genes and subgenomic mRNAs provides a powerful way to overcome innate immune activation.

Examples of a self-replicating RNA vector comprising a DLP motif are described in U.S. Patent Application Publication US2018/0171340 and the International Patent Application Publication WO2018/106615, the content of which is incorporated herein by reference in its entirety.

Any of the disclosed self-replicating RNA molecules can further comprise nonstructural genes nsP1, nsP2, nsP3, and/or nsP4. In some embodiments, the self-replicating RNA molecule does not encode a functional viral structural protein.

Alphavirus genomes encode non-structural proteins nsP1, nsP2, nsP3, and nsP4, which are produced as a single polyprotein precursor, sometimes designated P1234 (or nsP1-4 or nsP1234), and which is cleaved into the mature proteins through proteolytic processing (FIG. 9B). nsP1 can be about 60 kDa in size and may have methyltransferase activity and be involved in the viral capping reaction. nsP2 has a size of about 90 kDa and may have helicase and protease activity while nsP3 is about 60 kDa and contains three domains: a macrodomain, a central (or alphavirus unique) domain, and a hypervariable domain (HVD). nsP4 is about 70 kDa in size and contains the core RNA-dependent RNA polymerase (RdRp) catalytic domain. After infection the alphavirus genomic RNA is translated to yield a P1234 polyprotein, which is cleaved into the individual proteins.

Alphavirus genomes also encode three structural proteins: the core nucleocapsid protein C, and the envelope proteins P62 and E1 that associate as a heterodimer. Structural proteins are under the control of a subgenomic promoter and can be replaced by gene of interests (GIO).

In some embodiments, the self-replicating RNA molecule can lack (or not contain) the sequence(s) of at least one (or all) of the structural viral proteins (e.g. nucleocapsid protein C, and envelope proteins P62, 6K, and E1). In these embodiments, the sequences encoding one or more structural genes can be substituted with one or more heterologous sequences such as, for example, a coding sequence for at least one protein or peptide (or other gene of interest (GOI)) e.g. the disclosed prostate neoantigens.

The self-replicating RNA molecule can lack sequences encoding alphavirus structural proteins; or do not encode alphavirus (or, optionally, any other) structural proteins. In some embodiments, the self-replicating RNA molecule is further devoid of a part or the entire coding region for one or more viral structural proteins. For example, the alphavirus expression system may be devoid of a portion of or the entire coding sequence for one or more of the viral capsid protein C, E1 glycoprotein, E2 glycoprotein, E3 protein and 6K protein.

In some embodiments, the self-replicating RNA molecule does not contain coding sequences for at least one of the structural viral proteins. In these instances, the sequences encoding structural genes can be substituted with one or more heterologous sequences such as, for example, a coding sequence for a gene of interest (e.g., prostate neoantigens) FIG. 9.

The disclosure also provides a self-replicating RNA molecule comprising nonstructural genes nsP1, nsP2, nsP3, and nsP4, and wherein the self-replicating RNA molecule does not encode a functional viral structural protein. In some embodiments, the disclosure provides a self-replicating RNA molecule comprising the coding sequence for at least one, at least two, at least three, or at least four nonstructural viral proteins (e.g. nsP1, nsP2, nsP3, nsP4). The nsP1, nsP2, nsP3, and nsP4 proteins encoded by the replicon are functional or biologically active proteins.

The self-replicating RNA molecule can include the coding sequence for a portion of the at least one nonstructural viral protein. For example, the self-replicating RNA molecules can include about 10%, 20%, 30%, 40%, 50%, 60%, 70%, 80%, 90%, 95%, 100%, or a range between any two of these values, of the coding sequence for the at least one nonstructural viral protein. In some embodiments, the self-replicating RNA molecule can include the coding sequence for a substantial portion of the at least one nonstructural viral protein. As used herein, a "substantial portion" of a nucleic acid sequence encoding a nonstructural viral protein comprises enough of the nucleic acid sequence encoding the nonstructural viral protein to afford putative identification of that protein, either by manual evaluation of the sequence by one skilled in the art, or by computer-automated sequence comparison and identification using algorithms such as BEAST (see, for example, in "Basic Focal Alignment Search Tool"; Altschul S F et al., J. Mol. Biol. 215:403-410, 1993).

The self-replicating RNA molecule can include the entire coding sequence for the at least one nonstructural protein. In some embodiments, the self-replicating RNA molecule comprises substantially all the coding sequence for the native viral nonstructural proteins. In certain embodiments, the one or more nonstructural viral proteins are derived from the same virus.

The self-replicating RNA molecules can be an alphavirus-derived RNA replicon. In some embodiments, the alphavirus derived self-replicating RNA molecule is of an alphavirus belonging to the VEEV/EEEV group, or the SF group, or the SIN group. Non-limiting examples of SF group alphaviruses include Semliki Forest virus, O'Nyong-Nyong virus, Ross River virus, Middelburg virus, Chikungunya virus, Barmah Forest virus, Getah virus, Mayaro virus, Sagiyama virus, Bebaru virus, and Una virus. Non-limiting examples of SIN group alphaviruses include Sindbis virus, Girdwood S. A. virus, South African Arbovirus No. 86, Ockelbo virus, Aura virus, Babanki virus, Whataroa virus, and Kyzylagach virus. Non-limiting examples of VEEV/EEEV group alphaviruses include Eastern equine encephalitis virus (EEEV), Venezuelan equine encephalitis virus (VEEV), Everglades virus (EVEV), Mucambo virus (MUCV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), and Una vims (UNAV).

The alphavirus-derived self-replicating RNA molecule can be a Eastern equine encephalitis vims (EEEV), Venezuelan equine encephalitis vims (VEEV), Everglades vims (EVEV), Mucambo virus (MUCV), Semliki forest vims (SFV), Pixuna vims (PIXV), Middleburg vims (MIDV), Chikungunya vims (CHIKV), O'Nyong-Nyong virus (ONNV), Ross River vims (RRV), Barmah Forest vims (BF), Getah virus (GET), Sagiyama vims (SAGV), Bebaru virus (BEBV), Mayaro vims (MAYV), Una virus (UNAV), Sindbis virus (SINV), Aura virus (AURAV), Whataroa virus (WHAV), Babanki vims (BABV), Kyzylagach virus (KYZV), Western equine encephalitis virus (WEEV), Highland J virus (HJV), Fort Morgan vims (FMV), Ndumu (NDUV), and Buggy Creek vims. Virulent and avirulent alphavirus strains are both suitable. In some embodiments, the alphavirus RNA replicon is of a Sindbis vims (SIN), a Semliki Forest vims (SFV), a Ross River vims (RRV), a Venezuelan equine encephalitis vims (VEEV), or an Eastern equine encephalitis virus (EEEV).

The self-replicating RNA molecules can be derived from alphavirus genomes, meaning that they have some of the structural characteristics of alphavirus genomes, or be similar to them. The self-replicating RNA molecules can be derived from modified alphavirus genomes.

The self-replicating RNA molecules can contain RNA sequences from (or amino acid sequences encoded by) a wild-type New World or Old World alphavirus genome. Any of the self-replicating RNA molecules disclosed herein can contain RNA sequences "derived from" or "based on" wild type alphavirus genome sequences, meaning that they have at least 60% or at least 65% or at least 68% or at least 70% or at least 80% or at least 85% or at least 90% or at least 95% or at least 97% or at least 98% or at least 99% or 100% or 80-99% or 90-100% or 95-99% or 95-100% or 97-99% or 98-99% sequence identity with an RNA sequence (which can be a corresponding RNA sequence) from a wild type RNA alphavirus genome, which can be a New World or Old World alphavirus genome.

In some embodiments, the alphavirus-derived self-replicating RNA molecule is a Venezuelan equine encephalitis virus (VEEV).

In some embodiments, the downstream loop DLP of the self-replicating RNA molecule placed upstream of the nonstructural protein 1 (nsP1) is derived from Sindbis virus.

In some embodiments the self-replicating RNA molecule comprises nsP1, nsP2, nsP3, and nsP4 sequences derived from the Venezuelan equine encephalitis virus (VEEV) and a DLP motif derived from the Sindbis virus (SIN).

The self-replicating RNA molecules can also have an RNA sub-sequence encoding an amino acid sequence derived from an alphavirus nsP3 macro domain, and an RNA sub-sequence encoding an amino acid sequence derived from an alphavirus nsP3 central domain. The self-replicating RNA molecules can also have an RNA sub-sequence encoding an amino acid sequence derived entirely from an Old World alphavirus nsP3 hypervariable domain; or can have an amino acid sequence having a portion derived from a New World alphavirus nsP3 hypervariable domain, and a portion derived from an Old World alphavirus nsP3 hypervariable domain, i.e. the hyper variable domain (HVD) can be a hybrid or chimeric New World/Old World sequence.

In some embodiments, the self-replicating RNA molecules can have an RNA sequence encoding amino acid sequences derived from a wild type New World alphavirus nsP1, nsP2, nsP3, and nsP4 protein sequences. In other embodiments, the one or more nonstructural proteins are derived from different viruses.

In some embodiments, the self-replicating RNA molecule may have an RNA sequence encoding an nsP3 macro domain derived from a wild type alphavirus nsP3, and an nsP3 central domain derived from a wild type alphavirus nsP3. In various embodiments the macro and central domain (s) can both be derived from a New World wild type alphavirus nsP3 or can both be derived from an Old World wild type alphavirus nsP3 protein. In other embodiments, the macro domain can be derived from a New World wild type alphavirus macro domain and the central domain can be derived from an Old World wild type alphavirus central domain, or vice versa. The various domains can be of any sequence described herein.

In some embodiments, the self-replicating RNA molecule contains non VEEV nonstructural proteins nsP1, nsP2, nsP3, and nsP4.

The accumulated experimental evidence has demonstrated that replication/amplification of VEEV and other alphavirus genomes and their defective interfering (DI) RNAs is determined by three promoter elements: (i) the conserved 3'-terminal sequence element (3' CSE) and the following poly (A) tail; (ii) the 5' UTR, which functions as a key promoter element for both negative- and positive-strand RNA synthesis; and (iii) the 51-nt conserved sequence element (51-nt CSE), which is located in the nsP1-coding sequence and functions as an enhancer of alphavirus genome replication (Kim et al., PNAS, 2014, 111: 10708-10713, and references therein).

In some embodiments, the self-replicating RNA molecule can comprise an unmodified 5' untranslated region (5'UTR).

Previous studies have demonstrated that during VEEV and Sindbis virus infections only a small portion of viral nonstructural proteins (nsPs) is colocalized with dsRNA replication intermediates. Thus, it appears that a large fraction of nsPs are not involved in RNA replication (Gorchakov R, et al. (2008) A new role for ns polyprotein cleavage in Sindbis virus replication. J Virol 82(13): 6218-6231). This has provided an opportunity to exploit the under used ns proteins for amplification of the subgenomic RNAs encoding proteins of interest, which is normally transcribed from the subgenomic promoter and is not further amplified. In some embodiments, a fragment of the nsP1 of the self-replicating RNA molecule of the disclosure is duplicated downstream of the 5'-UTR and upstream of the DLP. In some embodiments the first 193 nucleotides of nsP1 are duplicated downstream of the 5' UTR and upstream of the DLP.

In some embodiment, a self-replicating RNA molecule comprises a modified 5' untranslated region (5'-UTR). For example, the modified 5'-UTR can comprise one or more nucleotide substitutions at position 1, 2, 4, or a combination thereof. Preferably, the modified 5'-UTR comprises a nucleotide substitution at position 2, more preferably, the modified 5'-UTR has a U→G substitution at position 2. Examples of such self-replicating RNA molecules are described in U.S. Patent Application Publication US2018/0104359 and the International Patent Application Publication WO2018/075235, the content of which is incorporated herein by reference in its entirety.

In some embodiments, the UTRs can be wild type New World or Old World alphavirus UTR sequences, or a sequence derived from any of them. The 5' UTR can be of any suitable length, such as about 60 nt or 50-70 nt or 40-80 nt. In some embodiments the 5' UTR can also have conserved primary or secondary structures (e.g. one or more stem-loop(s)) and can participate in the replication of alphavirus or of replicon RNA. The 3' UTR can be up to several hundred nucleotides, for example it can be 50-900 or 100-900 or 50-800 or 100-700 or 200-700 nt. The '3 UTR also can have secondary structures, e.g. a step loop, and can be followed by a polyadenylate tract or poly-A tail.

The 5' and 3' untranslated regions can be operably linked to any of the other sequences encoded by the replicon. The UTRs can be operably linked to a promoter and/or sequence encoding a protein or peptide by providing sequences and spacing necessary for recognition and transcription of the other encoded sequences.

One or more genes of interest (e.g. prostate neoantigens) can be expressed under the control of a subgenomic promoter. In certain embodiments, instead of the native subgenomic promoter, the subgenomic RNA can be placed under control of internal ribosome entry site (IRES) derived from encephalomyocarditis viruses (EMCV), Bovine Viral Diarrhea Viruses (BVDV), polioviruses, Foot-and-mouth disease viruses (FMD), enterovirus 71, or hepatitis C viruses. Subgenomic promoters range from 24 nucleotide (Sindbis virus) to over 100 nucleotides (Beet necrotic yellow vein virus) and are usually found upstream of the transcription start.

The self-replicating RNA molecules can have a 3' poly-A tail. It can also include a poly-A polymerase recognition sequence (e.g. AAUAAA) near its 3' end.

In those instances where the self-replicating RNA molecule is to be packaged into a recombinant alphavirus particle, it can contain one or more sequences, so-called packaging signals, which serve to initiate interactions with alphavirus structural proteins that lead to particle formation. In some embodiments, the alphavirus particles comprise RNA derived from one or more alphaviruses; and structural proteins wherein at least one of said structural proteins is derived from two or more alphaviruses.

Self-Replicating RNA Molecules Comprising RNA Corresponding to Variants of Engineered Polynucleotides Self-replicating RNA molecules comprising RNA corresponding to variants of the disclosed polynucleotides, or encoding variants of the disclosed polypeptides or fragments thereof, are within the scope of the disclosure. For example, self-replicating RNA molecules may comprise RNA corresponding the variants of the disclosed polynucleotides comprising one or more substitutions, deletions, or insertions, as long as the variants retain or have improved characteristics (such as immunogenicity or stability) when compared to the non-variant polynucleotide (i.e. the "parent" polynucleotide). In some embodiments, the sequence identity may be about 80%, 81%, 82%, 83%, 84%, 85%, 86%, 87%, 88%, 89%, 90%, 91%, 92%, 93%, 94%, 95%, 96%, 97%, 98% or 99% between the parent and the variant. In some embodiments, variants are generated by conservative substitutions. In some embodiments, the identity is about 80%. In some embodiments, the identity is about 85%. In some embodiments, the identity is about 90%. In some embodiments, the identity is about 91%. In some embodiments, the identity is about 92%. In some embodiments, the identity is about 93%. In some embodiments, the identity is about 94%. In some embodiments, the identity is about 95%. In some embodiments, the identity is about 96%. In some embodiments, the identity is about 97%. In some embodiments, the identity is about 98%. In some embodiments, the identity is about 99%.

The variants may comprise 1, 2, 3, 4, 5, 6, 7, 8, 9, 10, 11, 12, 13, 14, 15, 16, 17, 18, 19 or 20 substitutions, deletions or insertions, as long as the variants retain or have improved characteristics (such as immunogenicity or stability) when compared to the parent.

The percent identity between the two sequences is a function of the number of identical positions shared by the sequences (i.e., % identity=number of identical positions/total number of positions×100), taking into account the number of gaps, and the length of each gap, which need to be introduced for optimal alignment of the two sequences. The percent identity between two amino acid sequences may be determined using the algorithm of E. Meyers and W. Miller (*Comput Appl Biosci* 4:11-17 (1988)) which has been incorporated into the ALIGN program (version 2.0), using a PAM120 weight residue table, a gap length penalty of 12 and a gap penalty of 4. In addition, the percent identity between two amino acid sequences may be determined using the Needleman and Wunsch (*J Mol Biol* 48:444-453 (1970)) algorithm which has been incorporated into the GAP program in the GCG software package (available at www_gcg-_com), using either a Blossum 62 matrix or a PAM250 matrix, and a gap weight of 16, 14, 12, 10, 8, 6, or 4 and a length weight of 1, 2, 3, 4, 5, or 6.

The variants of the polypeptides or fragments thereof containing one amino acid alterations generally retain similar tertiary structure and antigenicity relative to the parent. In some instances, the variant may also contain at least one amino acid alteration that causes the variant to have increased antigenicity, increased binding affinity to TCR or to antibody, or both. The variants of the polypeptides may also have improved ability to bind to a HLA molecule.

The variants may be engineered to contain conservative substitutions. Conservative substitutions are herein defined as exchanges within one of the following five groups: Group 1-small aliphatic, nonpolar or slightly polar residues (Ala, Ser, Thr, Pro, Gly); Group 2-polar, negatively charged residues and their amides (Asp, Asn, Glu, Gin); Group 3-polar, positively charged residues (His, Arg, Lys); Group 4-large, aliphatic, nonpolar residues (Met, Leu, lie, Val, Cys); and Group 5-large, aromatic residues (Phe, Tyr, Trp).

The variants may be engineered to contain less conservative substitutions, such as the replacement of one amino acid by another that has similar characteristics but is somewhat different in size, such as replacement of an alanine by an isoleucine residue. The variants may also be engineered to contain highly non-conservative substitutions which may involve substituting an acidic amino acid for one that is polar, or even for one that is basic in character.

Additional substitutions that may be made to generate variants involve structures other than the common L-amino acids. Thus, D-amino and non-standard amino acids (i.e., other than the common naturally occurring proteinogenic amino acids) may also be used for substitution purposes to produce variants with enhanced immunogenicity when compared to the parent.

If substitutions at more than one position are found to result in polypeptides with substantially equivalent or greater immunogenicity, then combinations of those substitutions may be tested to determine if the combined substitutions result in additive or synergistic effects on the immunogenicity of the variant.

The amino acid residues that do not substantially contribute to interactions with the TCR may be modified by replacement with other amino acid whose incorporation does not substantially affect T-cell reactivity and does not eliminate binding to the relevant MHC. The amino acid residues that do not substantially contribute to interactions with the TCR may also be deleted as long as the deletion does not substantially affect T-cell reactivity and does not eliminate binding to the relevant MHC.

In addition, the polypeptides or fragments thereof or variants may be further modified to improve stability and/or binding to MHC molecules in order to elicit a stronger immune response. Methods for such an optimization of a peptide sequence are well known in the art and include, for example, the introduction of reverse peptide bonds or non-peptide bonds. In a reverse peptide bond, amino acid residues are not joined by peptide (—CO—NH—) linkages but the peptide bond is reversed. Such retro-inverso peptidomimetics may be made using methods known in the art. This approach involves making pseudopeptides containing changes involving the backbone, and not the orientation of side chains. Retro-inverse peptides, which contain NH—CO bonds instead of CO—NH peptide bonds are much more resistant to proteolysis. Additional non-peptide bond that may be used are, for example, $—CH_2—NH$, $—CH_2S—$, $—CH_2CH_2—$, $—CH{=}CH—$, $—COCH_2—$, $—CH(OH)CH_2—$, and $—CH_2SO—$.

The polypeptides or fragments thereof or variants may be synthesized with additional chemical groups present at their amino and/or carboxy termini, to enhance the stability, bioavailability, and/or affinity of the peptides. For example, hydrophobic groups such as carbobenzoxyl, dansyl, or t-butyloxycarbonyl groups may be added to the amino terminus. Likewise, an acetyl group or a 9-fluorenylmethoxy-carbonyl group may be placed at the amino termini. Additionally, the hydrophobic group, t-butyloxycarbonyl, or an amido group may be added to the carboxy termini.

Further, the polypeptides, fragments thereof, or variants may be synthesized to alter their steric configuration. For example, the D-isomer of one or more of the amino acid residues of the peptide may be used, rather than the usual L-isomer.

Similarly, the polypeptides, fragments thereof, or variants may be modified chemically by reacting specific amino acids either before or after synthesis of the polypeptides, fragments thereof, or variants. Examples for such modifications are well known in the art and are summarized e.g. in R. Lundblad, Chemical Reagents for Protein Modification, 3rd ed. CRC Press, 2004 (Lundblad, 2004). Chemical modifications of amino acids include modification by acylation, amidation, pyridoxylation of lysine, reductive alkylation, trinitrobenzylation of amino groups with 2,4,6-trinitrobenzene sulphonic acid (TNBS), amide modification of carboxyl groups and sulphydryl modification by performic acid oxidation of cysteine to cysteic acid, formation of mercurial derivatives, formation of mixed disulphides with other thiol compounds, reaction with maleimide, carboxymethylation with iodoacetic acid or iodoacetamide and carbamoylation with cyanate at alkaline pH, although without limitation thereto. In this regard, the skilled person is referred to Chapter 15 of Current Protocols In Protein Science, Eds. Coligan et al. (John Wiley and Sons NY 1995-2000) (Coligan et al., 1995) for more extensive methodology relating to chemical modification of proteins.

Briefly, modification of e.g. arginyl residues in proteins is often based on the reaction of vicinal dicarbonyl compounds such as phenylglyoxal, 2,3-butanedione, and 1,2-cyclohexanedione to form an adduct. Another example is the reaction of methylglyoxal with arginine residues. Cysteine can be modified without concomitant modification of other nucleophilic sites such as lysine and histidine. As a result, a large number of reagents are available for the modification of cysteine. The websites of companies such as Sigma-Aldrich (www sigma-aldrich) provide information on specific reagents. Selective reduction of disulfide bonds in proteins is also common. Disulfide bonds can be formed and oxidized during the heat treatment of biopharmaceuticals. Woodward's Reagent K may be used to modify specific glutamic acid residues. N-(3-(dimethylamino)propyl)-N'-ethylcarbodiimide can be used to form intra-molecular crosslinks between a lysine residue and a glutamic acid residue. For example, diethylpyrocarbonate is a reagent for the modification of histidyl residues in proteins. Histidine can also be modified using 4-hydroxy-2-nonenal. The reaction of lysine residues and other α-amino groups is, for example, useful in binding of peptides to surfaces or the cross-linking of proteins/peptides. Lysine is the site of attachment of poly(ethylene)glycol and the major site of modification in the glycosylation of proteins. Methionine residues in proteins can be modified with e.g. iodoacetamide, bromoethylamine, and chloramine T. Tetranitromethane and N-acetylimidazole can be used for the modification of tyrosyl residues. Cross-linking via the formation of dityrosine can be accomplished with hydrogen peroxide/copper ions. Recent studies on the modification of tryptophan have used N-bromosuccinimide, 2-hydroxy-5-nitrobenzyl bromide or 3-bromo-3-methyl-2-(2-nitrophenylmercapto)-3H-indole (BPNS-skatole). Successful modification of therapeutic proteins and peptides with PEG is often associated with an extension of circulatory half-life, while cross-linking of proteins with glutaraldehyde, polyethylene glycol diacrylate and formaldehyde is used for the preparation of hydrogels. Chemical modification of allergens for immunotherapy is often achieved by carbamylation with potassium cyanate.

The disclosure provides self-replicating RNA molecules comprising an RNA encoding an isolated polypeptide that is about 80%, 81%, 82%, 83%, 84%, 85%, 86%, 87%, 88%, 89%, 90%, 91%, 92%, 93%, 94%, 95%, 96%, 97%, 98% or 99% identical to the polypeptide of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 or 447.

The disclosure also provides self-replicating RNA molecules comprising an RNA encoding an isolated polypeptide having 1, 2, 3, 4, 5, 6, 7, 8, 9, 10, 11, 12, 13, 14, 15, 16, 17, 18, 19 or 20 substitutions, deletions or insertions when compared to the polypeptide of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 or 447.

The disclosure also provides self-replicating RNA molecules comprising an RNA corresponding to an isolated polynucleotide that is about 80%, 81%, 82%, 83%, 84%, 85%, 86%, 87%, 88%, 89%, 90%, 91%, 92%, 93%, 94%, 95%, 96%, 97%, 98% or 99% identical to the polynucleotide of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457 or 458.

The disclosure also provides self-replicating RNA molecules comprising an RNA encoding an isolated polypeptide that is about 80%, 81%, 82%, 83%, 84%, 85%, 86%, 87%, 88%, 89%, 90%, 91%, 92%, 93%, 94%, 95%, 96%, 97%, 98% or 99% identical to the polypeptide of SEQ ID NOs: 387, 388, 389, 390, 391, 392, 393, 394, 395, 396, 397, 398, 399, 400, 401, 402, 403, 404, 405, 406, 407, 408, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620 or 621.

The disclosure also provides self-replicating RNA molecules comprising an RNA encoding an isolated polypeptide that is about 80%, 81%, 82%, 83%, 84%, 85%, 86%, 87%, 88%, 89%, 90%, 91%, 92%, 93%, 94%, 95%, 96%, 97%, 98% or 99% identical to the polypeptide of SEQ ID NOs: 377, 378, 415, 417, 418, 420, 502, 518, 526, 527, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 74, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 487, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980 or 548.

The disclosure also provides self-replicating RNA molecules comprising an RNA encoding an isolated polypeptide that is about 80%, 81%, 82%, 83%, 84%, 85%, 86%, 87%, 88%, 89%, 90%, 91%, 92%, 93%, 94%, 95%, 96%, 97%, 98% or 99% identical to the polypeptide of SEQ ID NOs: 541, 550, 554, 555, 556, 623 or 624.

The disclosure also provides self-replicating RNA molecules comprising an RNA corresponding to an isolated polynucleotide that is about 80%, 81%, 82%, 83%, 84%, 85%, 86%, 87%, 88%, 89%, 90%, 91%, 92%, 93%, 94%, 95%, 96%, 97%, 98%, or 99% identical to the polynucleotide of SEQ ID NO: 542 or SEQ ID NO: 551.

The disclosure also provides self-replicating RNA molecules comprising an RNA encoding an isolated polypeptide that is about 80%, 81%, 82%, 83%, 84%, 85%, 86%, 87%, 88%, 89%, 90%, 91%, 92%, 93%, 94%, 95%, 96%, 97%, 98%, or 99% identical to the polypeptide of SEQ ID NOs: 543, 552, 557, 558, 559, 625 or 626.

The disclosure also provides a self-replicating RNA molecule comprising an RNA corresponding to an isolated polynucleotide that is about 80%, 81%, 82%, 83%, 84%, 85%, 86%, 87%, 88%, 89%, 90%, 91%, 92%, 93%, 94%, 95%, 96%, 97%, 98% or 99% identical to the polynucleotide of SEQ ID NO: 544 or SEQ ID NO: 553.

The disclosure also provides self-replicating RNA molecules comprising an RNA encoding an isolated polypeptide comprising an amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 and 447, and fragments thereof, wherein the polypeptide comprises one or more reverse peptide bonds.

The disclosure also provides self-replicating RNA molecules comprising RNA encoding an isolated polypeptide comprising an amino acid sequence of SEQ ID NOs: 387, 388, 389, 390, 391, 392, 393, 394, 395, 396, 397, 398, 399, 400, 401, 402, 403, 404, 405, 406, 407, 408, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620 or 621, wherein the polypeptide comprises one or more reverse peptide bonds.

The disclosure also provides self-replicating RNA molecules comprising RNA encoding an isolated polypeptide comprising an amino acid sequence of SEQ ID NOs: 377, 378, 415, 417, 418, 420, 502, 518, 526, 527, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 74, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 487, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980 or 548, wherein the polypeptide comprises one or more reverse peptide bonds.

The disclosure also provides self-replicating RNA molecules comprising an RNA encoding an isolated polypeptide comprising an amino acid sequence of SEQ ID NOs: 541, 550, 554, 555, 556, 623 or 624, wherein the polypeptide comprises one or more reverse peptide bonds.

The disclosure also provides self-replicating RNA molecules comprising an RNA encoding an isolated polypeptide comprising an amino acid sequence of SEQ ID NOs: 543, 552, 557, 558, 559, 625 or 626, wherein the polypeptide comprises one or more reverse peptide bonds.

In some embodiments, the reverse peptide bond comprises NH—CO bond. In some embodiments, the reverse peptide bond comprises $CH_2$—NH. —$CH_2$S—, —$CH_2CH_2$—, —CH═CH—, —$COCH_2$—, —CH(OH) $CH_2$—, or —$CH_2$SO— bond.

The disclosure also provides self-replicating RNA molecules comprising an RNA encoding an isolated polypeptide comprising an amino acid sequence of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 and 447, and fragments thereof, wherein the polypeptide comprises one or more chemical modifications.

The disclosure also provides self-replicating RNA molecules comprising an RNA encoding an isolated polypeptide comprising an amino acid sequence of SEQ ID NOs: 387, 388, 389, 390, 391, 392, 393, 394, 395, 396, 397, 398, 399, 400, 401, 402, 403, 404, 405, 406, 407, 408, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620 or 621, wherein the polypeptide comprises one or more chemical modifications.

The disclosure also provides self-replicating RNA molecules comprising an RNA encoding an isolated polypeptide comprising an amino acid sequence of SEQ ID NOs: 377, 378, 415, 417, 418, 420, 502, 518, 526, 527, 714, 715, 716, 717, 718, 719, 720, 721, 722, 723, 724, 725, 726, 727, 728, 729, 730, 731, 732, 733, 734, 735, 736, 737, 738, 739, 740, 741, 742, 743, 744, 745, 746, 747, 748, 749, 750, 751, 752, 753, 74, 755, 756, 757, 758, 759, 760, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 825, 826, 827, 828, 829, 830, 831, 832, 833, 834, 835, 836, 837, 838, 839, 840, 841, 842, 843, 844, 845, 846, 487, 848, 849, 850, 851, 852, 853, 854, 855, 856, 857, 858, 859, 860, 861, 862, 863, 864, 865, 866, 867, 868, 869, 870, 871, 872, 873, 874, 875, 876, 877, 878, 879, 880, 881, 882, 883, 884, 885, 886, 887, 888, 889, 890, 891, 892, 893, 894, 895, 896, 897, 898, 899, 900, 901, 902, 903, 904, 905, 906, 907, 908, 909, 910, 911, 912, 913, 914, 915, 916, 917, 918, 919, 920, 921, 922, 923, 924, 925, 926, 927, 928, 929, 930, 931, 932, 933, 934, 935, 936, 937, 938, 939, 940, 941, 942, 943, 944, 945, 946, 947, 948, 949, 950, 951, 952, 953, 954, 955, 956, 957, 958, 959, 960, 961, 962, 963, 964, 965, 966, 967, 968, 969, 970, 971, 972, 973, 974, 975, 976, 977, 978, 979, 980 or 548, wherein the polypeptide comprises one or more chemical modifications.

The disclosure also provides self-replicating RNA molecules comprising an isolated polypeptide comprising an amino acid sequence of SEQ ID NOs: 541, 550, 554, 555, 556, 623 or 624, wherein the polypeptide comprises one or more chemical modifications.

The disclosure also provides self-replicating RNA molecules comprising an RNA encoding an isolated polypeptide comprising an amino acid sequence of SEQ ID NOs: 543, 552, 557, 558, 559, 625 or 626, wherein the polypeptide comprises one or more chemical modifications.

In some embodiments, the one or more chemical modification comprises modification with carbobenzoxyl, dansyl, t-butyloxycarbonyl, 9-fluorenylmethoxy-carbonyl, or D-isomer of an amino acid.

Methods of Making Polynucleotides and Polypeptides

The polynucleotides of the disclosure or variants thereof may be in the form of RNA or in the form of DNA obtained by cloning or produced synthetically. The DNA may be double-stranded or single-stranded.

Methods of generating polynucleotides or variants thereof are known in the art and include chemical synthesis, enzymatic synthesis (e.g. in vitro transcription), enzymatic or chemical cleavage of a longer precursor, chemical synthesis of smaller fragments of the polynucleotides followed by ligation of the fragments or known PCR methods. The polynucleotide sequence to be synthesized may be designed with the appropriate codons for the desired amino acid sequence. In general, preferred codons may be selected for the intended host in which the sequence will be used for expression.

Methods of making polypeptides or variants thereof are known in the art and include standard molecular biology techniques for cloning and expression of the polypeptides and chemical synthesis of the polypeptides.

Peptides may be synthesized by the Fmoc-polyamide mode of solid-phase peptide synthesis as disclosed by Lukas et al. (Lukas et al., 1981) and by references as cited therein. Temporary N-amino group protection is afforded by the 9-fluorenylmethyloxycarbonyl (Fmoc) group. Repetitive cleavage of this highly base-labile protecting group is done using 20% piperidine in N, N-dimethylformamide. Side-chain functionalities may be protected as their butyl ethers (in the case of serine threonine and tyrosine), butyl esters (in the case of glutamic acid and aspartic acid), butyloxycarbonyl derivative (in the case of lysine and histidine), trityl derivative (in the case of cysteine) and 4-methoxy-2,3,6-trimethylbenzenesulphonyl derivative (in the case of arginine). Where glutamine or asparagine are C-terminal residues, use is made of the 4,4'-dimethoxybenzhydryl group for protection of the side chain amido functionalities. The solid-phase support is based on a polydimethyl-acrylamide polymer constituted from the three monomers dimethylacrylamide (backbone-monomer), bisacryloylethylene diamine (cross linker) and acryloylsarcosine methyl ester (functionalizing agent). The peptide-to-resin cleavable linked agent used is the acid-labile 4-hydroxymethyl-phenoxyacetic acid derivative. All amino acid derivatives are added as their preformed symmetrical anhydride derivatives with the exception of asparagine and glutamine, which are added using a reversed N, N-dicyclohexyl-carbodiimide/1 hydroxybenzotriazole mediated coupling procedure. All coupling and deprotection reactions are monitored using ninhydrin, trinitrobenzene sulphonic acid or isotin test procedures. Upon completion of synthesis, peptides are cleaved from the resin support with concomitant removal of side-chain protecting groups by treatment with 95% trifluoroacetic acid containing a 50% scavenger mix. Scavengers commonly used include ethanedithiol, phenol, anisole and water, the exact choice depending on the constituent amino acids of the peptide being synthesized. Also a combination of solid phase and solution phase methodologies for the synthesis of peptides is possible (see, for example, (Bruckdorfer et al., 2004), and the references as cited therein).

U.S. Pat. No. 4,897,445 provides a method for the solid phase synthesis of non-peptide bonds (—$CH_2$—NH) in polypeptide chains, which involves polypeptides synthesized by standard procedures and the non-peptide bond synthesized by reacting an amino aldehyde and an amino acid in the presence of $NaCNBH_3$.

Vectors Comprising DNA Encoding the Self-Replicating RNA Molecules

Vectors comprising DNA encoding the self-replicating RNA molecules are also provided. The disclosed vectors can be used, for example, to generate any of the disclosed self-replicating RNA molecules.

In some embodiments, the DNA encoding the self-replicating RNA molecule is within an alphaviral vector. Alphavirus vectors may be derived from any suitable plus-strand RNA viruses, such as alphaviruses or flaviviruses. The term "alphavirus" describes enveloped single-stranded positive sense RNA viruses of the family Togaviridae. The genus alphavirus contains approximately 30 members, which can infect humans as well as other animals.

Non-limiting examples of alphavirus species include Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), and Buggy Creek virus. Virulent and avirulent alphavirus strains are both suitable. In some embodiments, the alphavirus RNA replicon is of a Sindbis virus (SIN), a Semliki Forest virus (SFV), a Ross River virus (RRV), a Venezuelan equine encephalitis virus (VEEV), or an Eastern equine encephalitis virus (EEEV). In some embodiments, the alphavirus RNA replicon is of a Venezuelan equine encephalitis virus (VEEV).

Alphaviruses are classified in the Group IV Togaviridae family of viruses. These viruses carry a positive-sense single-stranded RNA genome, which typically ranges from 11 kb-12 kb. The alphavirus replicons can be 11 kb-12 kb in length, or 10-13 kb, or 7-20 kb or 7-25 kb in length, and can have a 5' cap and a 3' poly-A tail, which can be an alphavirus 5' cap and 3' poly-A tail. The 5' cap can be those known to persons of skill in the art, e.g. a 7-methylguanylate cap, or the anti-reverse cap analog 3'-O-Me-m7G(5')ppp(5')G or another analog cap structures. Alphavirus particles typically have a 70 nm diameter, tend to be spherical or slightly pleomorphic, and have a 40 nm isometric nucleocapsid.

Alphavirus vectors are engineered to replace the viral structural genes downstream of the replicase, which are under control of a subgenomic promoter, by genes of interest (GOI), e.g. prostate neoantigens. Sequences of at least one (or all) of the structural viral proteins (e.g. nucleocapsid protein C, and envelope proteins P62, 6K, and E1) are removed and replaced by the coding sequence for at least one prostate neoantigen or fragment thereof. In these embodiments, the sequences encoding one or more structural genes can be substituted with one or more heterologous sequences such as, for example, a coding sequence for at least one GOI e.g. the prostate neoantigens. Upon transfection, the replicase which is translated immediately, interacts with the 5' and 3' termini of the genomic RNA, and synthesizes complementary genomic RNA copies. Those act as templates for the synthesis of novel positive-stranded, capped, and poly-adenylated genomic copies, and subgenomic transcripts (FIG. 9B).

The disclosure also provides a recombinant VEEV derived vector comprising a polynucleotide encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 and 447, and fragments thereof.

In some embodiments, the VEEV derived vector comprises one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457 and 458, and fragments thereof.

The disclosure also provides a VEEV derived vector comprising a polynucleotide encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof.

In some embodiments, the VEEV vector comprises one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24 and 178, and fragments thereof.

In some embodiments, the alphavirus vector is a VEEV derived vector wherein the structural viral proteins (e.g. nucleocapsid protein C, and envelope proteins P62, 6K, and E1) are removed and replaced by the coding sequence for at least one of the disclosed prostate neoantigens.

In some embodiments, the self-replicating RNA vector is derived from an alphavirus vector.

In some embodiments, the self-replicating RNA vector is derived from a VEEV vector.

Provided herein is a DNA construct comprising the vector of SEQ ID NO: 981 and one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539 and 540, and fragments thereof.

The self-replicating RNA vectors can comprise any regulatory elements to establish conventional function(s) of the vector, including but not limited to, replication and expression of the prostate neoantigens encoded by the polynucleotide sequence of the vector. Regulatory elements include, but are not limited to, a promoter, an enhancer, a polyadenylation signal, translation stop codon, a ribosome binding element, a transcription terminator, selection markers, origin of replication, etc. A vector can comprise one or more expression cassettes. An "expression cassette" is part of a vector that directs the cellular machinery to make RNA and protein. An expression cassette typically comprises three components: a promoter sequence, an open reading frame, and a 3'-untranslated region (UTR) optionally comprising a polyadenylation signal. An open reading frame (ORF) is a reading frame that contains a coding sequence of a protein of interest (e.g., prostate neoantigen) from a start codon to a stop codon. Regulatory elements of the expression cassette can be operably linked to a polynucleotide sequence encoding a prostate neoantigen of interest. Any components suitable for use in an expression cassette described herein can be used in any combination and in any order to prepare the disclosed vectors.

The vector can comprise a promoter sequence, preferably within an expression cassette, to control expression of a prostate neoantigen. The term "promoter" is used in its conventional sense and refers to a nucleotide sequence that initiates the transcription of an operably linked nucleotide sequence. A promoter is located on the same strand near the nucleotide sequence it transcribes. Promoters can be a constitutive, inducible, or repressible. Promoters can be naturally occurring or synthetic. A promoter can be derived from sources including viral, bacterial, fungal, plants, insects, and animals. A promoter can be a homologous promoter (i.e., derived from the same genetic source as the vector) or a heterologous promoter (i.e., derived from a different vector or genetic source). Preferably, the promoter is located upstream of the polynucleotide encoding a prostate neoantigen within an expression cassette. For example, the promoter can be a subgenomic promoter for the alphavirus.

The vector can comprise additional polynucleotide sequences that stabilize the expressed transcript, enhance nuclear export of the RNA transcript, and/or improve transcriptional-translational coupling. Examples of such sequences include polyadenylation signals and enhancer sequences. A polyadenylation signal is typically located downstream of the coding sequence for a protein of interest (e.g., a prostate neoantigen) within an expression cassette of the vector. Enhancer sequences are regulatory DNA sequences that, when bound by transcription factors, enhance the transcription of an associated gene. An enhancer sequence is preferably located upstream of the polynucleotide sequence encoding a prostate neoantigen antigen, but downstream of a promoter sequence within an expression cassette of the vector.

Any enhancer sequence known to those skilled in the art can be used.

Any of the components or sequences of the self-replicating RNA vector can be functionally or operably linked to any other of the components or sequences. The components or sequences of the self-replicating RNA molecule can be operably linked for the expression of the at least one heterologous protein or peptide (or biotherapeutic) in a host cell or treated organism and/or for the ability of the replicon to self-replicate.

The term "operably linked" denotes a functional linkage between two or more sequences that are configured so as to perform their usual function. Thus, a promoter or UTR operably linked to a coding sequence is capable of effecting the transcription and expression of the coding sequence when the proper enzymes are present. The promoter need not be contiguous with the coding sequence, so long as it functions to direct the expression thereof. Thus, an operable linkage between an RNA sequence encoding a heterologous protein or peptide and a regulatory sequence (for example, a promoter or UTR) is a functional link that allows for expression of the polynucleotide of interest. Operably linked can also refer to sequences such as the sequences encoding the RdRp (e.g. nsP4), nsP1-4, the UTRs, promoters, and other sequences encoding in the RNA replicon, are linked so that they enable transcription and translation of the biotherapeutic molecule and/or replication of the replicon. The UTRs can be operably linked by providing sequences and spacing necessary for recognition and translation by a ribosome of other encoded sequences. As used herein, the term "operably linked" is to be taken in its broadest reasonable context and refers to a linkage of polynucleotide elements in a functional relationship. A polynucleotide is "operably linked" when it is placed into a functional relationship with another polynucleotide. For instance, a promoter is operably linked to a coding sequence if it affects the transcription of the coding sequence.

A molecule is functional or biologically active if it performs at least 50% of the same activity as its natural (or wild type), corresponding molecule, but a functional molecule can also perform at least 60% or at least 70% or at least 90% or at least 95% or 100% of the same activity as its natural (or wild type) corresponding molecule. The self-replicating RNA molecules can also encode an amino acid sequence derived from or based on a wild type alphavirus amino acid sequence, meaning that they have at least 60% or at least 65% or at least 68% or at least 70% or at least 80% at least 70% or at least 80% or at least 90% or at least 95% or at least 97% or at least 98% or at least 99% or 100% or 80-99% or 90-100% or 95-99% or 95-100% or 97-99% or 98-99% sequence identity with an amino acid sequence (which can be a corresponding sequence) encoded by a wild type RNA alphavirus genome, which can be a New World or Old World alphavirus genome. Sequences derived from other sequences can be up to 5% or up to 10% or up to 20% or up to 30% longer or shorter than the original sequence. In any of the embodiments the sequence identity can be at least 95% or at least 97% or at least 98% or at least 99% or 100% for any nucleotide sequence encoding (or amino acid sequence having) a G3BP or FXR binding site thereon. These sequences can also be up to 5% or up to 10% or up to 20% or up to 30% longer or shorter than the original sequence.

Self-Replicating RNA Delivery Vehicles

The disclosed self-replicating RNA molecules can be packaged, for example, into recombinant virus particles, such as recombinant alphavirus particles, or in lipid nanoparticles (LNP). The self-replicating RNA molecules may be at least 1 kb or at least 2 kb or at least 3 kb or at least 4 kb or at least 5 kb or at least 6 kb or at least 7 kb or at least 8 kb or at least 10 kb or at least 12 kb or at least 15 kb or at least 17 kb or at least 19 kb or at least 20 kb in size, or can be 100 bp-8 kb or 500 bp-8 kb or 500 bp-7 kb or 1-7 kb or 1-8 kb or 2-15 kb or 2-20 kb or 5-15 kb or 5-20 kb or 7-15 kb or 7-18 kb or 7-20 kb in size.

The self-replicating RNA molecules can be packaged or encapsulated in lipids. In some embodiments, the self-replicating RNA molecule can be packaged or encapsulated in cationic molecules, such as, polyamidoamine (Haensler and Szoka, 1993, Bioconjugate Chem. 4: 372-379), dendritic polylysine (Int. Pat. Publ. No. WO1995/24221), polyethylene irinine or polypropylene h-nine (Int. Pat. Publ. No. WO1996/02655), polylysine (U.S. Pat. No. 5,595,897), chitosan (U.S. Pat. No. 5,744,166), DNA-gelatin coarcervates (see, e.g., U.S. Pat. Nos. 6,207,195; 6,025,337; 5,972,707) or DEAE dextran (Lopata, et al., 1984, Nucleic Acid Res. 12: 5707-5717), dendrimers (see, e.g., WO1996/19240), or polyethylenimine (PEI) (see, e.g., Sun et at, 2014, Mol Med Rep. 10(5):2657-2662).

Figure 11:
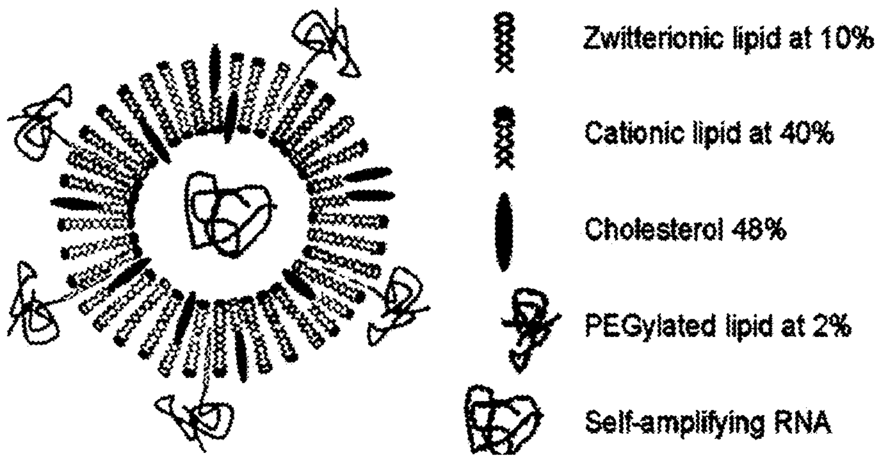
FIG. 11 is a schematic illustration of an exemplary lipid nanoparticle (LNP) encapsulating srRNA, with the percent molar ratios of lipid components as indicated (Geall et al., PNAS, 2012, 109:14604-14609).

The disclosed self-replicating RNA molecules and/or compositions comprising the self-replicating RNA molecules can be formulated using one or more liposomes, lipoplexes, and/or lipid nanoparticles. In some embodiments, pharmaceutical formulations of the self-replicating RNA molecules include liposomes (FIG. 11). Liposomes are artificially-prepared vesicles which can primarily be composed of a lipid bilayer and can be used as a delivery vehicle for the administration of nutrients and pharmaceutical formulations. Liposomes can be of different sizes such as, but not limited to, a multilamellar vesicle (MLV) which can be hundreds of nanometers in diameter and can contain a series of concentric bilayers separated by narrow aqueous compartments, a small unicellular vesicle (SUV) which can be smaller than 50 nm in diameter, and a large unilamellar vesicle (LUV) which can be between 50 and 500 nm in diameter. Liposome design can include, but is not limited to, opsonins or ligands in order to improve the attachment of liposomes to unhealthy tissue or to activate events such as, but not limited to, endocytosis. Liposomes can contain a low or a high pH in order to improve the delivery of the pharmaceutical formulations.

The formation of liposomes can depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In some embodiments, the self-replicating RNA molecule is encapsulated in, bound to, or adsorbed on a liposome, a lipoplex, a lipid nanoparticle, or combinations thereof. Preferably, the self-replicating RNA molecule is encapsulated in a lipid nanoparticle.

In some embodiments, the self-replicating RNA molecule can be fully encapsulated within the lipid portion of the particle, thereby protecting the RNA from nuclease degradation. "Fully encapsulated" means that the RNA is not significantly degraded after exposure to serum or a nuclease assay that would significantly degrade free RNA. When fully encapsulated, preferably less than 25% of the nucleic acid in the particle is degraded in a treatment that would normally degrade 100% of free nucleic acid, more preferably less than 10%, and most preferably less than 5% of the nucleic acid in the particle is degraded. "Fully encapsulated" also means that the nucleic acid-lipid particles do not rapidly decompose into their component parts upon in vivo administration.

In some embodiments, the encapsulated self-replicating RNA molecule is encapsulated in a lipid nanoparticle.

In some embodiments, the lipid nanoparticles comprise an RNA, a cationic lipid (e.g., one or more cationic lipids or salts thereof described herein), a phospholipid, and a conjugated lipid that inhibits aggregation of the particles (e.g., one or more PEG-lipid conjugates). The lipid particles can also include cholesterol. The lipid particles may comprise at least 1, 2, 3, 4, 5, 6, 7, 8, 9, 10, or more RNA that express one or more polypeptides.

The disclosure provides an encapsulated self-replicating RNA molecule, wherein the lipid nanoparticle comprises an RNA, a cationic lipid, a phospholipid cholesterol and/or a conjugated lipid.

The self-replicating RNA molecules and/or compositions comprising the same can be formulated in a lipid vesicle which can have crosslinks between functionalized lipid bilayers. In some embodiments, the self-replicating RNA molecules and/or compositions of the disclosure can be formulated in a lipid-poly cation complex. The formation of the lipid-polycation complex can be accomplished by methods known in the art. As a non-limiting example, the polycation can include a cationic peptide or a polypeptide such as, but not limited to, poly lysine, poly ornithine and/or polyarginine and the cationic peptides. In some embodiments, the self-replicating RNA molecules and/or compositions disclosed herein can be formulated in a lipid-poly cation complex which can further include a neutral lipid such as, but not limited to, cholesterol or dioleoyl phosphatidylethanolamine (DOPE). The liposome formulation can be influenced by, but not limited to, the selection of the cationic lipid component, the degree of cationic lipid saturation, the nature of the PEGylation, ratio of all components and biophysical parameters such as size.

In some embodiments, the LNP formulations comprising a poly cationic composition can be used for the delivery of the modified RNA described herein in vivo and/or ex vitro. The disclosure further provides a LNP formulations comprising a cationic lipid.

The terms "cationic lipid" and "amino lipid" are used interchangeably herein to include those lipids and salts thereof having one, two, three, or more fatty acid or fatty alkyl chains and a pH-titratable amino head group (e.g., an alkylamino or dialkylamino head group). The cationic lipid is typically protonated (i.e., positively charged) at a pH below the pKa of the cationic lipid and is substantially neutral at a pH above the pKa. The cationic lipids may also be termed titratable cationic lipids. In some embodiments, the cationic lipids comprise: a protonatable tertiary amine (e.g., pH-titratable) head group; C18 alkyl chains, wherein each alkyl chain independently has 0 to 3 (e.g., 0, 1, 2, or 3) double bonds; and ether, ester, or ketal linkages between the head group and alkyl chains. Such cationic lipids include, but are not limited to, DSDMA, DODMA, DLinDMA, DLenDMA, γ-DLenDMA, DLin-K-DMA, DLin-K-C2-DMA (also known as DLin-C2K-DMA, XTC2, and C2K), DLin-K-C3-DM A, DLin-K-C4-DMA, DLen-C2K-DMA, y-DLen-C2K-DMA, DLin-M-C2-DMA (also known as MC2), DLin-M-C3-DMA (also known as MC3) and (DLin-MP-DMA)(also known as 1-B1 1).

The disclosure also provides an encapsulated self-replicating RNA molecule, wherein the cationic lipid comprises a protonatable tertiary amine.

In some embodiments, the cationic lipid is di((Z)-non-2-en-1-yl) 8,8'-((((2-(dimethylamino)ethyl)thio)carbonyl)azanediyl)dioctanoate.

In certain embodiments, the cationic lipid compounds are relatively non-cytotoxic. The cationic lipid compounds may be biocompatible and biodegradable. The cationic lipid may have a pKa in the range of approximately 5.5 to approximately 7.5, more preferably between approximately 6.0 and approximately 7.0.

The cationic lipid compounds are particularly attractive for drug delivery for several reasons: they contain amino groups for interacting with DNA, RNA, other polynucleotides, and other negatively charged agents, for buffering the pH, for causing endo-osmolysis, for protecting the self-replicating RNA molecule to be delivered, they can be synthesized from commercially available starting materials; and/or they are pH responsive and can be engineered with a desired pKa.

Lipid nanoparticle formulations can be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and can be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it can be terminally located at the terminal end of the lipid chain. The internal ester linkage can replace any carbon in the lipid chain. The lipid particles may comprise a lipid conjugate. The conjugated lipid is useful in that it prevents the aggregation of particles. Suitable conjugated lipids include, but are not limited to, PEG-lipid conjugates, cationic-polymer-lipid conjugates, and mixtures thereof.

PEG is a linear, water-soluble polymer of ethylene PEG repeating units with two terminal hydroxyl groups. PEGs are classified by their molecular weights; and include the following: monomethoxypolyethylene glycol (MePEG-OH), monomethoxypolyethylene glycol-succinate (MePEG-S), monomethoxypolyethylene glycol-succinimidyl succinate (MePEG-S-NHS), monomethoxypolyethylene glycol-amine (MePEG-NH2), monomethoxypolyethylene glycol-tresylate (MePEG-TRES), monomethoxypolyethylene glycol-imidazolyl-carbonyl (MePEG-IM), as well as such compounds containing a terminal hydroxyl group instead of a terminal methoxy group (e.g, HO-PEG-S, HO-PEG-S-NHS, HO-PEG-NH2).

The PEG moiety of the PEG-lipid conjugates may comprise an average molecular weight ranging from 550 daltons to 10,000 daltons.

The disclosure provides a self-replicating RNA molecule encapsulated in a lipid nanoparticle comprising a conjugated lipid, wherein the conjugated lipid is a PEG-lipid. Examples of PEG-lipids include, but are not limited to, PEG coupled to dialkyloxypropyls (PEG-DAA), PEG coupled to diacylglycerol (PEG-DAG), PEG coupled to phospholipids such as phosphatidylethanolamine (PEG-PE), PEG conjugated to ceramides, PEG conjugated to cholesterol or a derivative thereof, and mixtures thereof.

In some embodiments, the conjugated lipid is a PEG-lipid.

In some embodiments, the conjugated lipid is a DMG-PEG-2000. The self-replicating RNA molecules can also be formulated in a particle comprising non-cationic lipids. Suitable non-cationic lipids include, for example, neutral uncharged, zwitterionic, or anionic lipids capable of producing a stable complex.

Non-limiting examples of non-cationic lipids include phospholipids such as lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidic acid, cerebrosides, dicetylphosphate, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoylphosphatidylethanolamine (DOPE), palmitoyloleoyl-phosphatidylcholine (POPC), palmitoyloleoyl-phosphatidylethanolamine (POPE), palmitoyloleyol-phosphatidylglycerol (POPG), dioleoylphosphatidylethanolamine 4-(N-maleimidomethyl)-cyclohexane-1-carboxylate (DOPE-mal), phosphatidylethanolamine, phosphatidylethanolaminedipalmitoyl-dimyristoyl-distearoyl-monomethyl-dimethyl-dielaidoyl-stearoyloleoyl-phosphatidylethanolamine (SOPE), lysophosphatidylcholine, dilinoleoylphosphatidylcholine, and mixtures thereof. Other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, palmitoyl, stearoyl, or oleoyl.

Additional examples of non-cationic lipids include sterols such as cholesterol and derivatives thereof. Non-limiting examples of cholesterol derivatives include polar analogues such as 5a-cholestanol, 5a-coprostanol, cholesteryl-(2'-hydroxy)-ethyl ether, cholesteryl-(4'-hydroxy)-butyl ether, and 6-ketocholestanol; non-polar analogues such as 5a-cholestane, cholestenone, 5a-cholestanone, 5a-cholestanone, and cholesteryl decanoate; and mixtures thereof. In preferred embodiments, the cholesterol derivative is a polar analogue such as cholesteryl-(4'-hydroxy)-butyl ether. In some embodiments, the phospholipid is DSPC. In some embodiments, the non-cationic lipid present in lipid particles comprises or consists of a mixture of one or more phospholipids and cholesterol or a derivative thereof. In some embodiments where the lipid particles contain a mixture of phospholipid and cholesterol or a cholesterol derivative, the mixture may comprise up to 40 mol %, 45 mol %, 50 mol %, 55 mol %, or 60 mol % of the total lipid present in the particle.

A composition containing a cationic lipid compound may be 30-70% cationic lipid compound, 0-60% cholesterol, 0-30% phospholipid and 1-10% polyethylene glycol (PEG).

In some embodiments, the cationic lipid, zwitterion lipid, cholesterol and conjugated lipid are combined in a molar ratio of 50:7:40:3, respectively in the lipid nanoparticle.

In some embodiments, the LNP formulations described herein can additionally comprise a permeability enhancer molecule. The nanoparticle formulations can be a carbohydrate nanoparticle comprising a carbohydrate carrier and self-replicating RNA. As a non-limiting example, the carbohydrate carrier can include, but is not limited to, an anhydride-modified phytoglycogen or glycogen-type material, phtoglycogen octenyl succinate, phytoglycogen beta-dextrin, and anhydride-modified phytoglycogen beta-dextrin.

The self-replicating RNA molecules and/or compositions comprising the same can also be formulated as a nanoparticle using a combination of polymers, lipids, and/or other biodegradable agents, such as, but not limited to, calcium phosphate, polymers. Components can be combined in a core-shell, hybrid, and/or layer-by-layer architecture, to allow for fine-tuning of the nanoparticle so that delivery of the molecules and/or compositions of the disclosure can be enhanced.

Vaccines, Methods of Inducing an Immune Response, and Methods of Treating or Preventing Prostate Cancer Also provided herein are vaccines comprising any of the disclosed prostate cancer neoantigens. The disclosed vaccines can comprise a vector containing the prostate cancer neoantigen or a nucleic acid encoding the prostate cancer neoantigen.

The preparation of vaccine compositions is well known. Vaccines may comprise or may be formulated into a pharmaceutical composition comprising the vaccine and a pharmaceutically acceptable excipient. "Pharmaceutically acceptable" refers to the excipient that at the dosages and concentrations employed, will not cause unwanted or harmful effects in the subjects to which they are administered and include carrier, buffers, stabilizers or other materials well known to those skilled in the art. The precise nature of the carrier or other material may depend on the route of administration, e.g., intramuscular, subcutaneous, oral, intravenous, cutaneous, intramucosal (e.g., gut), intranasal or intraperitoneal routes. Liquid carriers such as water, petroleum, animal or vegetable oils, mineral oil or synthetic oil may be included. Physiological saline solution, dextrose or other saccharide solution or glycols such as ethylene glycol, propylene glycol or polyethylene glycol may be included. Exemplary viral formulation are the Adenovirus World Standard (Hoganson et al., 2002): 20 mM Tris pH 8, 25 mM NaCl, 2.5% glycerol; or 20 mM Tris, 2 mM $MgCl_2$, 25 mM NaCl, sucrose 10% w/v, polysorbate-80 0.02% w/v; or 10-25 mM citrate buffer pH 5.9-6.2, 4-6% (w/w) hydroxypropyl-beta-cyclodextrin (HBCD), 70-100 mM NaCl, 0.018-0.035% (w/w) polysorbate-80, and optionally 0.3-0.45% (w/w) ethanol. Many other buffers can be used, and examples of suitable formulations for the storage and for pharmaceutical administration of purified pharmaceutical preparations are known.

The vaccine may comprise one or more adjuvants. Suitable adjuvants include QS-21, Detox-PC, MPL-SE, MoGM-CSF, TiterMax-G, CRL-1005, GERBU, TERamide, PSC97B, Adjumer, PG-026, GSK-I, GcMAF, B-alethine, MPC-026, Adjuvax, CpG ODN, Betafectin, Alum, and MF59. Other adjuvants that may be used include lectins, growth factors, cytokines and lymphokines such as alpha-interferon, gamma interferon, platelet derived growth factor (PDGF), granulocyte-colony stimulating factor (gCSF), granulocyte macrophage colony stimulating factor (gMCSF), tumor necrosis factor (TNF), epidermal growth factor (EGF), IL-1, IL-2, IL-4, IL-6, IL-8, IL-10, IL-12 or TLR agonists.

"Adjuvant" and "immune stimulant" are used interchangeably herein and are defined as one or more substances that cause stimulation of the immune system. In this context, an adjuvant is used to enhance an immune response to the vaccines or viral vectors described herein. The adjuvant can be present in a composition or administered in a separate composition. An adjuvant can be, e.g., a small molecule or an antibody. Examples of adjuvants suitable for use in the application include, but are not limited to, immune checkpoint inhibitors (e.g., anti-PD1, anti-TIM-3, etc.), toll-like receptor agonists (e.g., TLR7 and/or TLR8 agonists), RIG-1 agonists, IL-15 superagonists (Altor Bioscience), mutant IRF3 and IRF7 genetic adjuvants, STING agonists (Aduro), FLT3L genetic adjuvant, IL12 genetic adjuvant, and IL-7-hyFc.

The disclosed vaccines can comprise any of the self-replicating RNA molecules disclosed herein. The vaccine can comprise a self-replicating RNA molecule comprising an RNA encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446, 447, and fragments thereof.

The vaccine can comprise a self-replicating RNA molecule comprising an RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, 177, and fragments thereof.

The vaccine can comprise a self-replicating RNA molecule comprising an RNA encoding a polypeptide of SEQ ID NOs: 541, 543, 550, 552, 554, 555, 556, 557, 558, 559, 623, or 624, 625 or 626.

The vaccine can comprise a self-replicating RNA molecule comprising an RNA corresponding to one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539, 540, and fragments thereof.

The vaccine can comprise a self-replicating RNA molecule comprising an RNA corresponding to one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24, 178, and fragments thereof.

For example, a polynucleotide of SEQ ID NO: 542 encoding a polypeptide of SEQ ID NO: 541 may be used to generate self-replicating RNA molecule-based prostate cancer vaccines. Alternatively, polynucleotides encoding polypeptides of SEQ ID NOs: 550, 554, 555, 556, 623 or 624 may also be used in the self-replicating RNA molecule-based vaccines. In addition to the polynucleotide encoding the combination of the 41 neoantigens, additional facilitator elements may be included to the 5' or 3' of the polynucleotide, such as regulatory sequences, tags, and the like. Exemplary facilitator elements include CMV promoter, vaccinia P7.5 promoter, TetO repressor, Kozak sequence, a polynucleotide encoding a T cell enhancer (TCE), a polynucleotide encoding a histidine tag, one or more stop codons, a polyadenylation signal or a promoter sequence. Exemplary polynucleotide sequences of the facilitator elements comprise CMVTetO promoter comprising SEQ ID NO: 628, Kozak sequence comprising SEQ ID NO: 545, the polynucleotide encoding the TCE comprising SEQ ID NO: 546, the polynucleotide encoding the histidine tag comprising SEQ ID NO: 547, a BGH polyadenylation site comprising SEQ ID NO: 629, the one or more stop codons comprising the polynucleotide sequence of TAGTAA, the CMV promoter comprising a polynucleotide of SEQ ID NO: 628 or the vaccinia P7.5 promoter comprising a polynucleotide of SEQ ID NO: 630. Thus the polynucleotide comprising one or more additional facilitator sequences can comprise the polynucleotide sequence of SEQ ID NO: 551, encoding the polypeptide of SEQ ID NO: 550.

Also provided herein are vaccines that comprise recombinant viruses comprising the disclosed prostate cancer neoantigens. Suitable recombinant viruses can be derived from an adenovirus (Ad), a poxvirus, an adeno-associated virus (AAV), or a retrovirus.

Adenoviruses may be derived from human adenovirus (Ad) but also from adenoviruses that infect other species, such as bovine adenovirus (e.g. bovine adenovirus 3, BAdV3), a canine adenovirus (e.g. CAdV2), a porcine adenovirus (e.g. PAdV3 or 5), or great apes, such as Chimpanzee (*Pan*), Gorilla (*Gorilla*), Orangutan (*Pongo*), Bonobo (*Pan paniscus*) and common chimpanzee (*Pan troglodytes*). Typically, naturally occurring great ape adenoviruses are isolated from stool samples of the respective great ape.

Human adenoviruses may be derived from various adenovirus serotypes, for example, from human adenovirus serotypes hAd5, hAd7, hAd11, hAd26, hAd34, hAd35, hAd48, hAd49, or hAd50 (the serotypes are also referred to as Ad5, Ad7, Ad11, Ad26, Ad34, Ad35, Ad48, Ad49, or Ad50).

Great ape adenoviruses may be derived from various adenovirus serotypes, for example from great ape adenovirus serotypes GAd20, GAd19, GAd21, GAd25, GAd26, GAd27, GAd28, GAd29, GAd30, GAd31, ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd55, ChAd63, ChAd73, ChAd82, ChAd83, ChAd146, ChAd147, PanAd1, PanAd2, or PanAd3.

Adenoviruses are known in the art. The sequences of most of the human and non-human adenoviruses are known, and for others can be obtained using routine procedures. An exemplary genome sequence of Ad26 is found in GenBank Accession number EF153474 and in SEQ ID NO: 1 of Int. Pat. Publ. No. WO2007/104792. An exemplary genome sequence of Ad35 is found in FIG. 6 of Int. Pat. Publ. No. WO2000/70071. Ad26 is described, for example, in Int. Pat. Publ. No. WO2007/104792. Ad35 is described, for example, in U.S. Pat. No. 7,270,811 and Int. Pat. Publ. No. WO2000/70071. ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd63 and ChAd82 are described in WO2005/071093. PanAd1, PanAd2, PanAd3, ChAd55, ChAd73, ChAd83, ChAd146, and ChAd147 are described in Int. Pat. Publ. No. WO2010/086189.

Adenoviruses are engineered to comprise at least one functional deletion or a complete removal of a gene product that is essential for viral replication, such as one or more of the adenoviral regions E1, E2, and E4, therefore rendering the adenovirus to be incapable of replication. The deletion of the E1 region may comprise deletion of EIA, EIB 55K or EIB 21K, or any combination thereof. Replication deficient adenoviruses are propagated by providing the proteins encoded by the deleted region(s) in trans by the producer cell by utilizing helper plasmids or engineering the produce cell to express the required proteins. The adenovirus may also have a deletion in the E3 region, which is dispensable for replication, and hence such a deletion does not have to be complemented. The adenovirus may comprise a functional deletion or a complete removal of the E1 region and at least part of the E3 region. The adenovirus may further comprise a functional deletion or a complete removal of the E4 region and/or the E2 region. Suitable producer cells that can be utilized are human retina cells immortalized by E1, e.g. 911 or PER.C6 cells (see, e.g., U.S. Pat. No. 5,994,128), E1-transformed amniocytes (See, e.g., EP 1230354), E1-transformed A549 cells (see e.g. Int. Pat. Publ. No. WO1998/39411; U.S. Pat. No. 5,891,690). Ad26 viruses comprising a functional E1 coding region that is sufficient for viral replication, a deletion in the E3 coding region, and a deletion in the E4 coding region, may be used provided that E4 open reading frame 6/7 is not deleted (see e.g. U.S. Pat. No. 9,750,801).

In some embodiments, the adenovirus is a human adenovirus (Ad). In some embodiments, the Ad is derived from Ad5. In some embodiments, the Ad is derived from Ad11. In some embodiments, the Ad is derived from Ad26. In some embodiments, the Ad is derived from Ad34. In some embodiments, the Ad is derived from Ad35. In some embodiments, the Ad is derived from Ad48. In some embodiments, the Ad is derived from Ad49. In some embodiments, the Ad is derived from Ad50.

The adenovirus may also be a great ape adenovirus (GAd). In some embodiments, the GAd is derived from GAd20. In some embodiments, the GAd is derived from GAd19. In some embodiments, the GAd is derived from GAd21. In some embodiments, the GAd is derived from GAd25. In some embodiments, the GAd is derived from GAd26. In some embodiments, the GAd is derived from GAd27. In some embodiments, the GAd is derived from GAd28. In some embodiments, the GAd is derived from GAd29. In some embodiments, the GAd is derived from GAd30. In some embodiments, the GAd is derived from GAd31. In some embodiments, the GAd is derived from ChAd4. In some embodiments, the GAd is derived from ChAd5. In some embodiments, the GAd is derived from ChAd6. In some embodiments, the GAd is derived from ChAd7. In some embodiments, the GAd is derived from ChAd8. In some embodiments, the GAd is derived from ChAd9. In some embodiments, the GAd is derived from ChAd20. In some embodiments, the GAd is derived from ChAd22. In some embodiments, the GAd is derived from ChAd24. In some embodiments, the GAd is derived from ChAd26. In some embodiments, the GAd is derived from ChAd30. In some embodiments, the GAd is derived from ChAd31. In some embodiments, the GAd is derived from ChAd32. In some embodiments, the GAd is derived from ChAd33. In some embodiments, the GAd is derived from ChAd37. In some embodiments, the GAd is derived from ChAd38. In some embodiments, the GAd is derived from ChAd44. In some embodiments, the GAd is derived from ChAd55. In some embodiments, the GAd is derived from ChAd63. In some embodiments, the GAd is derived from ChAd68. In some embodiments, the GAd is derived from ChAd73. In some embodiments, the GAd is derived from ChAd82. In some embodiments, the GAd is derived from ChAd83.

GAd19-21 and GAd25-31 are described in Int. Pat. Publ. No. WO2019/008111 and represent strains with high immunogenicity and no pre-existing immunity in the general human population. The polynucleotide sequence of GAd20 genome is provided in SEQ ID NO: 622 as disclosed in WO2019/008111.

The disclosed polynucleotides may be inserted into a site or region (insertion region) in the virus that does not affect the viability of the resultant recombinant virus. The polynucleotides may be inserted into the deleted E1 region in parallel (transcribed 5' to 3') or anti-parallel (transcribed in a 3' to 5' direction relative to the vector backbone) orientation. In addition, appropriate transcriptional regulatory elements that are capable of directing expression of the polypeptides in the mammalian host cells that the virus is being prepared for use may be operatively linked to the polynucleotides. “Operatively linked” sequences include both expression control sequences that are contiguous with the nucleic acid sequences that they regulate and regulatory sequences that act in trans, or at a distance to control the regulated nucleic acid sequence.

Recombinant adenoviral particles may be prepared and propagated according to any conventional technique in the field of the art (e.g., Int. Pat. Publ. No. WO1996/17070) using a complementation cell line or a helper virus, which supplies in trans the missing viral genes necessary for viral replication. The cell lines 293 (Graham et al., 1977, J. Gen. Virol. 36: 59-72), PER.C6 (see e.g. U.S. Pat. No. 5,994,128), E1 A549 and 911 are commonly used to complement E1 deletions. Other cell lines have been engineered to complement defective vectors (Yeh, et al. 1996, J. Virol. 70: 559-565; Kroughak and Graham, 1995, Human Gene Ther. 6: 1575-1586; Wang, et at, 1995, Gene Ther. 2: 775-783; Lusky, et al., 1998, J. Virol. 72: 2022-203; EP 919627 and Int. Pat. Publ. No. WO1997/04119). The adenoviral particles may be recovered from the culture supernatant but also from the cells after lysis and optionally further purified according to standard techniques (e.g., chromatography, ultracentrifugation, as described in Int. Pat. Publ. No. WO1996/27677, Int. Pat. Publ. No. WO1998/00524, Int. Pat. Publ. No. WO1998/26048 and Int. Pat. Publ. No. WO2000/50573). The construction and methods for propagating adenoviruses are also described in for example, U.S. Pat. Nos. 5,559,099, 5,837,511, 5,846,782, 5,851,806, 5,994,106, 5,994,128, 5,965,541, 5,981,225, 6,040,174, 6,020,191, and 6,113,913.

Poxvirus (Poxviridae) may be derived from smallpox virus (variola), vaccinia virus, cowpox virus, or monkeypox virus. Exemplary vaccinia viruses are the Copenhagen vaccinia virus (W), New York Attenuated Vaccinia Virus (NYVAC), ALVAC, TROVAC, and Modified Vaccinia Ankara (MVA).

MVA originates from the dermal vaccinia strain Ankara (Chorioallantois vaccinia Ankara (CVA) virus) that was maintained in the Vaccination Institute, Ankara, Turkey for many years and used as the basis for vaccination of humans. However, due to the often severe post-vaccinal complications associated with vaccinia viruses (VACV), there were several attempts to generate a more attenuated, safer smallpox vaccine. MVA has been generated by 516 serial passages on chicken embryo fibroblasts of the CVA virus (see Meyer et al., *J. Gen. Virol.,* 72: 1031-1038 (1991) and U.S. Pat. No. 10,035,832). As a consequence of these long-term passages the resulting MVA virus deleted about 31 kilobases of its genomic sequence and, therefore, was described as highly host cell restricted to avian cells (Meyer, H. et al., Mapping of deletions in the genome of the highly attenuated vaccinia virus MVA and their influence on virulence, J. Gen. Virol. 72, 1031-1038, 1991; Meisinger-Henschel et al. Genomic sequence of chorioallantois vaccinia virus Ankara, the ancestor of modified vaccinia virus Ankara, J. Gen. Virol. 88, 3249-3259, 2007). Comparison of the MVA genome to its parent, CVA, revealed 6 major deletions of genomic DNA (deletion I, II, III, IV, V, and VI), totaling 31,000 basepairs. (Meyer et al., J. Gen. Virol. 72:1031-8 (1991)). It was shown in a variety of animal models that the resulting MVA was significantly avirulent (Mayr, A. & Danner, K. Vaccination against pox diseases under immunosuppressive conditions, Dev. Biol. Stand. 41: 225-34, 1978). Being that many passages were used to attenuate MVA, there are a number of different strains or isolates, depending on the passage number in CEF cells, such as MVA 476 MG/14/78, MVA-571, MVA-572, MVA-574, MVA-575 and MVA-BN. MVA 476 MG/14/78 is described for example in Int. Pat. Publ. No. WO2019/115816A1. MVA-572 strain was deposited at the European Collection of Animal Cell Cultures (“ECACC”), Health Protection Agency, Microbiology Services, Porton Down, Salisbury SP4 0JG, United Kingdom (“UK”), under the deposit number ECACC 94012707 on Jan. 27, 1994. MVA-575 strain was deposited at the ECACC under deposit number ECACC 00120707 on Dec. 7, 2000; MVA-Bavarian Nordic (“MVA-BN”) strain was deposited at the ECACC under deposit number V00080038 on Aug. 30, 2000. The genome sequences of MVA-BN and MVA-572 are available at GenBank (Accession numbers DQ983238 and DQ983237, respectively). The genome sequences of other MVA strains can be obtained using standard sequencing methods.

The disclosed viruses may be derived from any MVA strain or further derivatives of the MVA strain. A further exemplary MVA strain is deposit VR-1508, deposited at the American Type Culture collection (ATCC), Manassas, Va. 20108, USA.

“Derivatives” of MVA refer to viruses exhibiting essentially the same characteristics as the parent MVA, but exhibiting differences in one or more parts of their genomes.

In some embodiments, the MVA virus is derived from MVA 476 MG/14/78. In some embodiments, the MVA virus is derived from MVA-571. In some embodiments, the MVA virus is derived from MVA-572. In some embodiments, the MVA virus is derived from MVA-574. In some embodiments, the MVA virus is derived from MVA-575. In some embodiments, the MVA virus is derived from MVA-BN.

The disclosed polynucleotides may be inserted into a site or region (insertion region) in the MVA virus that does not affect the viability of the resultant recombinant virus. Such regions can be readily identified by testing segments of virus DNA for regions that allow recombinant formation without seriously affecting virus viability of the recombinant virus.

The thymidine kinase (TK) gene is an insertion region that may be used and is present in many viruses, such as in all examined poxvirus genomes. Additionally, MVA contains 6 natural deletion sites, each of which may be used as insertion sites (e.g. deletion I, II, III, IV, V, and VI; see e.g. U.S. Pat. Nos. 5,185,146 and 6,440,442). One or more intergenic regions (IGR) of the MVA may also be used as an insertion site, such as IGRs IGR07/08, IGR 44/45, IGR 64/65, IGR 88/89, IGR 136/137, and IGR 148/149 (see e.g. U.S. Pat. Publ. No. 2018/0064803). Additional suitable insertion sites are described in Int. Pat. Publ. No. WO2005/048957.

Recombinant poxviral particles such as rMVA can be prepared as described in the art (Piccini, et al., 1987, Methods of Enzymology 153: 545-563; U.S. Pat. Nos. 4,769,330; 4,772,848; 4,603,112; 5,100,587 and 5,179,993). In an exemplary method, the DNA sequence to be inserted into the virus can be placed into an *E. coli* plasmid construct into which DNA homologous to a section of DNA of the MVA has been inserted. Separately, the DNA sequence to be inserted can be ligated to a promoter. The promoter-gene linkage can be positioned in the plasmid construct so that the promoter-gene linkage is flanked on both ends by DNA homologous to a DNA sequence flanking a region of MVA DNA containing a non-essential locus. The resulting plasmid construct can be amplified by propagation within *E. coli* bacteria and isolated. The isolated plasmid containing the DNA gene sequence to be inserted can be transfected into a cell culture, e.g., of chicken embryo fibroblasts (CEFs), at the same time the culture is infected with MVA. Recombination between homologous MVA DNA in the plasmid and the viral genome, respectively, can generate an MVA modified by the presence of foreign DNA sequences. rMVA particles may be recovered from the culture supernatant or from the cultured cells after a lysis step (e.g., chemical lysis, freezing/thawing, osmotic shock, sonication and the like). Consecutive rounds of plaque purification can be used to remove contaminating wild type virus. Viral particles can then be purified using the techniques known in the art (e.g., chromatographic methods or ultracentrifugation on cesium chloride or sucrose gradients).

Other suitable viruses include human adeno-associated viruses, such as AAV-2 (adeno-associated virus type 2). An attractive feature of AAVs is that they do not express any viral genes. The only viral DNA sequences included in the AAV are the 145 bp inverted terminal repeats (ITR). Thus, as in immunization with naked DNA, the only gene expressed is that of the antigen, or antigen chimera. Additionally, AAVs are known to transduce both dividing and non-dividing cells, such as human peripheral blood monocyte-derived dendritic cells, with persistent transgene expression, and with the possibility of oral and intranasal delivery for generation of mucosal immunity. Moreover, the amount of DNA required appears to be much less by several orders of magnitude, with maximum responses at doses of $10^{10}$ to $10^{11}$ particles or copies of DNA in contrast to naked DNA doses of 50 μg or about $10^{15}$ copies. AAVs are packaged by co-transfection of a suitable cell line (e.g., human 293 cells) with the DNA contained in the AAV ITR chimeric protein encoding constructs and an AAV helper plasmid ACG2 containing the AAV coding region (AAV rep and cap genes) without the ITRs. The cells are subsequently infected with the adenovirus Ad5. Viruses can be purified from cell lysates using methods known in the art (e.g., such as cesium chloride density gradient ultracentrifugation) and are validated to ensure that they are free of detectable replication-competent AAV or adenovirus (e.g., by a cytopathic effect bioassay).

Retroviruses may also be used. Retroviruses are a class of integrative viruses which replicate using a virus-encoded reverse transcriptase, to replicate the viral RNA genome into double stranded DNA which is integrated into chromosomal DNA of the infected cells (e.g., target cells). Such viruses include those derived from murine leukemia viruses, especially Moloney (Gilboa, et al., 1988, Adv. Exp. Med. Biol. 241: 29) or Friend's FB29 strains (Int. Pat. Publ. No. WO1995/01447). Generally, a retrovirus is deleted of all or part of the viral genes gag, pol, and env and retains 5' and 3' FTRs and an encapsidation sequence. These elements may be modified to increase expression level or stability of the retrovirus. Such modifications include the replacement of the retroviral encapsidation sequence by one of a retrotransposon such as VF30 (see, e.g., U.S. Pat. No. 5,747,323). The disclosed polynucleotides may be inserted downstream of the encapsidation sequence, such as in opposite direction relative to the retroviral genome. Retroviral particles are prepared in the presence of a helper virus or in an appropriate complementation (packaging) cell line which contains integrated into its genome the retroviral genes for which the retrovirus is defective (e.g. gag/pol and env). Such cell lines are previously described (Miller and Rosman, 1989, BioTechniques 7: 980; Danos and Mulligan, 1988, Proc. Natl. Acad. Sci. USA 85: 6460; Markowitz, et al., 1988, Virol. 167: 400). The product of the env gene is responsible for the binding of the viral particle to the viral receptors present on the surface of the target cell and, therefore determines the host range of the retroviral particle. Packaging cell lines, such as the PA317 cells (ATCC CRT 9078) or 293EI6 (WO97/35996) containing an amphotropic envelope protein may therefore be used to allow infection of human and other species' target cells. The retroviral particles are recovered from the culture supernatant and may optionally be further purified according to standard techniques (e.g. chromatography, ultracentrifugation).

Also provided are pharmaceutical compositions comprising any of the disclosed self-replicating RNA molecules or vaccines, wherein the pharmaceutical composition comprises a pharmaceutically acceptable excipient.

Provided herein are methods of inducing an immune response in a subject and methods of beating or preventing prostate cancer in a subject. The methods comprise administering any of the disclosed self-replicating RNA molecules or any of the disclosed vaccines to the subject. In some embodiments, the methods comprise administering a vector encoding the self-replicating RNA molecules. In some embodiments, the methods comprise administering a lipid/self-replicating RNA molecule complex. In some embodiments, the methods comprise administering a vaccine comprising the self-replicating RNA molecules. In some embodiments, the methods comprise administering the self-replicating RNA molecule and one or more polynucleotides or polypeptides as described herein. In some embodiments, the methods comprise administering a vaccine comprising any of the disclosed self-replicating RNA molecules and a vaccine comprising any of the disclosed recombinant viruses. Any of the compositions described herein can be used in the disclosed methods.

The methods of inducing an immune response and methods of beating or preventing prostate cancer can comprise administering a self-replicating RNA molecule, a lipid/self-replicating RNA molecule complex, or a self-replicating RNA molecule-containing vaccine, wherein the self-replicating RNA molecule comprises an RNA encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446, 447, and fragments thereof.

The methods of inducing an immune response and methods of beating or preventing prostate cancer can comprise administering a self-replicating RNA molecule, a lipid/self-replicating RNA molecule complex, or a self-replicating RNA molecule-containing vaccine, wherein the self-replicating RNA molecule comprises an RNA corresponding to one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539, 540, and fragments thereof.

The methods of inducing an immune response and methods of treating or preventing prostate cancer can comprise administering a self-replicating RNA molecule, a lipid/self-replicating RNA molecule complex, or a self-replicating RNA molecule-containing vaccine, wherein the self-replicating RNA molecule comprises an RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, 177, and fragments thereof.

The methods of inducing an immune response and methods of treating or preventing prostate cancer can comprise administering a self-replicating RNA molecule, a lipid/self-replicating RNA molecule complex, or a self-replicating RNA molecule-containing vaccine, wherein the self-replicating RNA molecule comprises an RNA corresponding to one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24, 178, and fragments thereof.

The methods of inducing an immune response and methods of treating or preventing prostate cancer can comprise administering a self-replicating RNA molecule, a lipid/self-replicating RNA molecule complex, or a self-replicating RNA molecule-containing vaccine, wherein the self-replicating RNA molecule comprises an RNA encoding a polypeptide of SEQ ID NOs: 541, 543, 550, 552, 554, 555, 556, 557, 558, 559, 623, or 624, 625 or 626.

The phrase "inducing an immune response" when used with reference to the methods described herein encompasses causing a desired immune response or effect in a subject in need thereof against prostate neoantigens. "Inducing an immune response" also encompasses providing a therapeutic immunity for treating against prostate neoantigens. As used herein, the term "therapeutic immunity" or "therapeutic immune response" means that the vaccinated subject is able to control the production of prostate neoantigens within a cell, for instance immunity against prostate neoantigens conferred by vaccination with prostate neoantigen vaccine. In an embodiment, "inducing an immune response" means producing an immunity in a subject in need thereof, e.g., to provide a therapeutic effect against a disease, such as prostate cancer. In certain embodiments, "inducing an immune response" refers to causing or improving cellular immunity, e.g., T cell response, against prostate neoantigens. In certain embodiments, "inducing an immune response" refers to causing or improving a humoral immune response against prostate neoantigens. In certain embodiments, "inducing an immune response" refers to causing or improving a cellular and a humoral immune response against prostate neoantigens.

As used herein, the term "protective immunity" or "protective immune response" means that the vaccinated subject is able to control the spread of a disease against which the vaccination was done. Usually, the subject having developed a "protective immune response" develops only mild to moderate clinical symptoms or no symptoms at all.

Typically, the administration of the disclosed compositions will have a therapeutic aim to generate an immune response against prostate neoantigens.

As used herein, "an immunogenically effective amount" or "immunologically effective amount" means an amount of a composition, polynucleotide, vector, antigen, vaccine, etc. sufficient to induce a desired immune effect or immune response in a subject in need thereof. An immunogenically effective amount can be an amount sufficient to induce an immune response in a subject in need thereof. An immunogenically effective amount can be an amount sufficient to produce immunity in a subject in need thereof, e.g., provide a therapeutic effect against a disease such as prostate cancer. An immunogenically effective amount can vary depending upon a variety of factors, such as, the physical condition of the subject, age, weight, health, etc., and the particular application, e.g., providing protective immunity or therapeutic immunity. An immunogenically effective amount can readily be determined by one of skill in the art in view of the present disclosure.

An immunogenically effective amount can refer to the amount of a composition which is sufficient to achieve one, two, three, four, or more of the following effects: (i) reduce or ameliorate the severity of prostate cancer or a symptom associated therewith; (ii) reduce the duration of prostate cancer or symptom associated therewith; (iii) prevent the progression of prostate cancer or symptom associated therewith; (iv) cause regression of an prostate cancer or symptom associated therewith; (v) prevent the development or onset of prostate cancer, or symptom associated therewith; (vi) prevent the recurrence of prostate cancer or symptom associated therewith; (vii) reduce hospitalization of a subject having prostate cancer; (viii) reduce hospitalization length of a subject having prostate cancer; (ix) increase the survival of a subject with prostate cancer; (x) eliminate prostate cancer in a subject; (xi) inhibit or reduce prostate cancer proliferation in a subject; and/or (xii) enhance or improve the prophylactic or therapeutic effect(s) of another therapy.

It is expected that the immunogenically effective amount will fall in a relatively broad range that can be determined through routine trials. The RNA content of compositions will generally be expressed in terms of the amount of RNA per dose. For example, a dose can have ≤10 μg RNA, and expression can be seen at much lower levels e.g. ≤1 μg/dose, ≤100 ng/dose, ≤10 ng/dose, ≤1 ng/dose, etc.

An immunogenically effective amount can be from one vector, or from multiple vectors. As further general guidance, an immunogenically effective amount when used with reference to a peptide can range from about 10 μg to 1 mg per administration, such as 10, 20, 50, 100, 200, 300, 400, 500, 600, 700, 800, 9000, or 1000 μg per administration. An immunogenically effective amount can be administered in a single composition, or in multiple compositions, such as 1, 2, 3, 4, 5, 6, 7, 8, 9, or 10 compositions (e.g., tablets, capsules or injectables, or any composition adapted to intradermal delivery, e.g., to intradermal delivery using an intradermal delivery patch), wherein the administration of the multiple capsules or injections collectively provides a subject with an immunogenically effective amount. It is also possible to administer an immunogenically effective amount to a subject, and subsequently administer another dose of an immunogenically effective amount to the same subject, in a so-called prime-boost regimen. This general concept of a prime-boost regimen is well known to the skilled person in the vaccine field. Further booster administrations can optionally be added to the regimen, as needed.

Preferably, an immunogenically effective amount refers to the amount of a composition which is sufficient to treat prostate cancer.

In some embodiments, the methods of inducing an immune response comprises administering to the subject any of the disclosed self-replicating RNA molecules. In some embodiments, the methods of inducing an immune response comprises administering to the subject a vaccine comprising any of the disclosed self-replicating RNA molecules. The disclosed self-replicating RNA molecules, the polynucleotides, the polypeptides, the vectors, the recombinant viruses, and the vaccines can be administered to a subject by any method known in the art, including, but not limited to, parenteral administration (e.g., intramuscular, subcutaneous, intravenous, or intradermal injection), oral administration, transdermal administration, and nasal administration. In some embodiments, the administration is via parenteral (e.g., by intramuscular injection or intradermal injection) or transdermal administration.

The prostate cancer neoantigens disclosed herein can be present at a frequency of at least about 1% or more, about 2% or more, about 3% or more, about 4% or more, about 5% or more, about 6% or more, about 7% or more, about 8% or more, about 9% or more, about 10% or more, about 11% or more, about 12% or more, about 13% or more, about 14% or more, about 15% or more, about 16% or more, about 17% or more, about 18% or more, about 19% or more, about 20% or more, about 21% or more, about 22% or more, about 23% or more, about 24% or more, about 25% or more, about 26% or more, about 27% or more, about 28% or more, about 29% or more, about 30% or more, about 35% or more, about 40% or more, about 45% or more, about 50% or more, about 55% or more, about 60% or more, about 65% or more, or about 70% or more in a population of subjects having the prostate cancer.

Also provided is the use of any of the disclosed vaccines for the preparation of a medicament for treating or preventing a prostate cancer.

Also provided is the use of any of the disclosed vaccines for the preparation of a pharmaceutical composition for treating or preventing a prostate cancer.

Also provided is any of the disclosed vaccines for use in treating or preventing a prostate cancer.

Also provided are methods of treating or preventing a prostate cancer in a subject, comprising administering to the subject a therapeutically effective amount of one or more of the disclosed pharmaceutical compositions.

"Prostate cancer" is meant to include all types of cancerous growths within prostate or oncogenic processes, metastatic tissues or malignantly transformed cells, tissues, or organs, irrespective of histopathology type or stage of invasiveness. In some embodiments, the prostate cancer is an adenocarcinoma. In some aspects, the prostate cancer is a localized prostate adenocarcinoma. In some embodiments, the prostate cancer is a metastatic prostate cancer. In some embodiments, the prostate cancer has metastasized to rectum, lymph node or bone, or any combination thereof. In some embodiments, the prostate cancer is a relapsed or a refractory prostate cancer. In some embodiments, the prostate cancer is a castration resistant prostate cancer. In some embodiments, the prostate cancer is sensitive to an androgen deprivation therapy. In some embodiments, the prostate cancer is insensitive to the androgen deprivation therapy. In some embodiments, the subject is treatment naïve. In some embodiments, the subject has received androgen deprivation therapy.

In some embodiments, the subject has an elevated level of prostate specific antigen (PSA). PSA is elevated in a subject when the level is typically about ≥4.0 ng/mL. In some instances, elevated PSA may refer to level off ≥3.0 ng/mL. PSA levels may also be compared to post-androgen deprivation therapy levels.

Androgen deprivation therapies include abiraterone, ketoconazole, enzalutamide, galeterone, ARN-509 and orteronel (TAK-700), or prostatectomy.

In some embodiments, the self-replicating RNA molecules are administered as part of a "prime-boost" regimen. In some embodiments, the self-replicating RNA molecule is a primer vaccine used for priming an immune response. In some embodiments, the self-replicating RNA molecule is a booster vaccine used for boosting an immune response. This general concept of a prime-boost regimen is well known to the skilled person in the vaccine field. Any of the vaccines and compositions described herein can be used as priming and/or boosting vaccines for priming and/or boosting an immune response against prostate neoantigens.

In some embodiments, the primer vaccine can be re-administered for boosting immunization. Further booster administrations can optionally be added to the regimen, as needed. An adjuvant can be present in the booster vaccine, present in a separate composition to be administered together with the booster vaccine, or administered on its own as the boosting immunization.

An illustrative and non-limiting example of a prime-boost regimen includes administering a single dose of an immunogenically effective amount of a composition to a subject to prime the immune response; and subsequently administering another dose of an immunogenically effective amount of a composition to boost the immune response, wherein the boosting immunization is first administered about two to six weeks, preferably four weeks after the priming immunization is initially administered. Optionally, about 10 to 14 weeks, preferably 12 weeks, after the priming immunization is initially administered, a further boosting immunization of the composition or other adjuvant, is administered.

The disclosed self-replicating RNA molecules can be administered in a prime-boost regimen with one or more polynucleotides, one or more polypeptides, or one or more vaccines comprising:

a), one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539, 540, and fragments of the preceding sequences;

b). one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24, 178, and fragments thereof;

c). one or more polynucleotides selected from the group consisting of SEQ ID NOs: 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, and fragments thereof;

d). one or more polynucleotides selected from the group consisting of SEQ ID NOs: 500, 501, 461, 503, 504, 505, 506, 507, 508, 509, 510, 511, 512, 513, 514, 515, 516, 517, 477, 519, 520, 521, 522, 523, 524, 525, 485, 486, 528, 529, 530, 531, 532, 533, 534, 535, 536, 537, 538, 539, 540, and fragments thereof;

e). a polynucleotide sequence of SEQ ID NOs: 542, 551, 544, or 553;

f). a polynucleotide encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446, 447, and fragments of the preceding sequences;

g). a polynucleotide encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, 177, and fragments thereof;

h). a polynucleotide encoding a polypeptide of any one of SEQ ID NOs: 541, 550, 554, 555, 556, 623, 624, 543, 552, 557, 558, 559, 625, or 626;

i). one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446, 447, and fragments of the preceding sequences;

j). one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, 177, and fragments thereof;

k). a polypeptide comprising the amino acid sequence of any one of SEQ ID NOs: 541, 550, 554, 555, 556, 623, 624, 543, 552, 557, 558, 559, 625, or 626; or l). a vaccine comprising any of the above polynucleotides or polypeptides.

The disclosed polynucleotides and polypeptides can be attached to nanoparticles for delivery to a subject. Delivery of the polypeptides or fragments thereof, the polynucleotides encoding them or the vectors comprising the polynucleotides using nanoparticles may eliminate the need to include a virus or an adjuvant in the vaccine composition. The polynucleotide may be DNA or RNA. The nanoparticles may contain immune danger signals that help to effectively induce an immune response to the peptides. The nanoparticles may induce dendritic cell (DC) activation and maturation, required for a robust immune response. The nanoparticles may contain non-self components that improve uptake of the nanoparticles and thus the peptides by cells, such as antigen presenting cells.

The nanoparticles are typically from about 1 nm to about 100 nm in diameter, such as about 20 nm to about 40 nm. Nanoparticles with a mean diameter of 20 to 40 nm may facilitate uptake of the nanoparticle to the cytosol (see. e.g. WO2019/135086). Exemplary nanoparticles are polymeric nanoparticles, inorganic nanoparticles, liposomes, lipid nanoparticles (LNP), an immune stimulating complex (ISCOM), a virus-like particle (VLP), or a self-assembling protein. The nanoparticles may be calcium phosphate nanoparticles, silicon nanoparticles or gold nanoparticles. The polymeric nanoparticles may comprise one or more synthetic polymers, such as poly(d,l-lactide-co-glycolide) (PLG), poly(d,l-lactic-coglycolic acid) (PLGA), poly(g-glutamic acid) (g-PGA)m polyethylene glycol) (PEG), or polystyrene or one or more natural polymers such as a polysaccharide, for example pullulan, alginate, inulin, and chitosan. The use of a polymeric nanoparticles may be advantageous due to the properties of the polymers that may be include in the nanoparticle. For instance, the natural and synthetic polymers recited above may have good biocompatibility and biodegradability, a non-toxic nature and/or the ability to be manipulated into desired shapes and sizes. The polymeric nanoparticle may also form hydrogel nanoparticles, hydrophilic three-dimensional polymer networks with favorable properties including flexible mesh size, large surface area for multivalent conjugation, high water content, and high loading capacity for antigens. Polymers such as Poly(L-lactic acid) (PLA), PLGA, PEG, and polysaccharides are suitable for forming hydrogel nanoparticles. Inorganic nanoparticles typically have a rigid structure and comprise a shell in which an antigen is encapsulated or a core to which the antigen may be covalently attached. The core may comprise one or more atoms such as gold (Au), silver (Ag), copper (Cu) atoms, Au/Ag, Au/Cu, Au/Ag/Cu, Au/Pt, Au/Pd or Au/Ag/Cu/Pd or calcium phosphate (CaP).

The nanoparticles may be liposomes. Liposomes are typically formed from biodegradable, non-toxic phospholipids and comprise a self-assembling phospholipid bilayer shell with an aqueous core. Liposomes may be an unilamellar vesicle comprising a single phospholipid bilayer, or a multilamellar vesicle that comprises several concentric phospholipid shells separated by layers of water. As a consequence, liposomes may be tailored to incorporate either hydrophilic molecules into the aqueous core or hydrophobic molecules within the phospholipid bilayers. Liposomes may encapsulate antigens such as the polypeptides or fragments thereof of the disclosure within the core for delivery. Liposomes and liposomal formulations can be prepared according to standard methods and are well known in the art, see, e.g., Remington's; Akimaru, 1995, Cytokines Mol. Ther. 1: 197-210; Alving, 1995, Immunol. Rev. 145: 5-31; Szoka, 1980, Ann. Rev. Biophys. Bioeng. 9: 467; U.S. Pat. Nos. 4,235,871; 4,501,728; and 4,837,028. The liposomes may comprise a targeting molecule for targeting liposome complexes to a particular cell type. Targeting molecule may comprise a binding partner (e.g., a ligand or receptor) for a biomolecule (e.g., a receptor or ligand) on the surface of a blood vessel or a cell found in a target tissue. Liposome charge is an important determinant in liposome clearance from the blood, with negatively charged liposomes being taken up more rapidly by the reticuloendothelial system (Juliano, 1975, Biochem. Biophys. Res. Commun. 63: 651) and thus having shorter half-lives in the bloodstream. Incorporating phosphatidylethanolamine derivatives enhances the circulation time by preventing liposomal aggregation. For example, incorporation of N-(omega-carboxy)acylamidophosphatidylethanolamines into large unilamellar vesicles of L-alpha-distearoylphosphatidylcholine dramatically increases the in vivo liposomal circulation lifetime (see, e.g., Ahl, 1997, Biochim. Biophys. Acta 1329: 370-382). Typically, liposomes are prepared with about 5 to 15 mole percent negatively charged phospholipids, such as phosphatidylglycerol, phosphatidylserine or phosphatidyl-inositol. Added negatively charged phospholipids, such as phosphatidylglycerol, also serve to prevent spontaneous liposome aggregation, and thus minimize the risk of undersized liposomal aggregate formation. Membrane-rigidifying agents, such as sphingomyelin or a saturated neutral phospholipid, at a concentration of at least about 50 mole percent, and 5 to 15 mole percent of monosialylganglioside can also impart desirably liposome properties, such as rigidity (see, e.g., U.S. Pat. No. 4,837,028). Additionally, the liposome suspension can include lipid-protective agents which protect lipids against free-radical and lipid-peroxidative damages on storage. Lipophilic free-radical quenchers, such as alpha-tocopherol and water-soluble iron-specific chelators, such as ferrioxianine, are preferred.

The nanoparticles may be lipid nanoparticles (LNP). LNPs are similar to liposomes but have slightly different function and composition. LNPs are designed toward encapsulating polynucleotides, such as DNA, mRNA, siRNA and sRNA. Traditional liposomes contain an aqueous core surrounded by one or more lipid bilayers. LNPs may assume a micelle-like structure, encapsulating drug molecules in a non-aqueous core. LNPs typically contain a cationic lipid, a non-cationic lipid, and a lipid that prevents aggregation of the particle (e.g., a PEG-lipid conjugate). LNPs are useful for systemic applications, as they exhibit extended circulation lifetimes following intravenous (i.e.) injection and accumulate at distal sites (e.g., sites physically separated from the administration site). The LNPs may have a mean diameter of about 50 nm to about 150 nm, such as about 60 nm to about 130 nm, or about 70 nm to about 110 nm, or about 70 nm to about 90 nm, and are substantially nontoxic. Preparation of polynucleotide loaded LNPs are disclosed in, e.g., U.S. Pat. Nos. 5,976,567; 5,981,501; 6,534,484; 6,586,410; 6,815,432; and PCT Publication No. WO 96/40964. Polynucleotide containing LNPs are described for example in WO2019/191780.

The nanoparticles can include multilamellar vesicles of heterogeneous sizes. For example, vesicle-forming lipids can be dissolved in a suitable organic solvent or solvent system and dried under vacuum or an inert gas to form a thin lipid film. If desired, the film can be redissolved in a suitable solvent, such as tertiary butanol, and then lyophilized to form a more homogeneous lipid mixture which is in a more easily hydrated powder like form. This film is covered with an aqueous solution of the polypeptide complex and allowed to hydrate, typically over a 15 to 60 minute period with agitation. The size distribution of the resulting multilamellar vesicles can be shifted toward smaller sizes by hydrating the lipids under more vigorous agitation conditions or by adding solubilizing detergents such as deoxycholate. The hydration medium may comprise the nucleic acid at a concentration which is desired in the interior volume of the liposomes in the final liposome suspension. Suitable lipids that may be used to form multilamellar vesicles include DOTMA (Feigner, et al., 1987, Proc. Natl. Acad. Sci. USA 84: 7413-7417), DOGS or Transfectain™ (Behr, et al., 1989, Proc. Natl. Acad. Sci. USA 86: 6982-6986), DNERIE or DORIE (Feigner, et al., Methods 5: 67-75), DC-CHOL (Gao and Huang, 1991, BBRC 179: 280-285), DOTAP™ (McLachlan, et al., 1995, Gene Therapy 2: 674-622), Lipofectamine™. and glycerolipid compounds (see, e.g., EP901463 and WO98/37916).

The nanoparticle may be an immune-stimulating complex (ISCOM). ISCOMs are cage-like particles which are typically formed from colloidal saponin-containing micelles. ISCOMs may comprise cholesterol, phospholipid (such as phosphatidylethanolamine or phosphatidylcholine) and saponin (such as Quil A from the tree *Quillaia saponaria*).

The nanoparticle may be a virus-like particle (VLP). VLPs are self-assembling nanoparticles that lack infectious nucleic acid, which are formed by self-assembly of biocompatible capsid protein. VLPs are typically about 20 to about 150 nm, such as about 20 to about 40 nm, about 30 to about 140 nm, about 40 to about 130 nm, about 50 to about 120 nm, about 60 to about 110 nm, about 70 to about 100 nm, or about 80 to about 90 nm in diameter. VLPs advantageously harness the power of evolved viral structure, which is naturally optimized for interaction with the immune system. The naturally-optimized nanoparticle size and repetitive structural order means that VLPs induce potent immune responses, even in the absence of adjuvant.

The nanoparticles may contain replicons that encode the polypeptides of the disclosure. The replicons may be DNA or RNA.

The methods of inducing an immune response or treating or preventing prostate cancer in a subject can comprise administering to the subject a therapeutically effective amount of a first vaccine comprising any of the disclosed self-replicating RNA molecules for priming the immune response ("prime vaccine"), and administering to the subject a therapeutically effective amount of a second vaccine comprising an MVA for boosting the immune response ("boost vaccine"), thereby inducing an immune response, treating the prostate cancer, or preventing the prostate cancer in the subject.

The methods of inducing an immune response or treating or preventing prostate cancer in a subject can comprise administering to the subject a therapeutically effective amount of a first vaccine comprising any of the disclosed self-replicating RNA molecules for priming the immune response ("prime vaccine"), and administering to the subject a therapeutically effective amount of a second vaccine comprising a Ad26 for boosting the immune response ("boost vaccine"), thereby inducing an immune response, beating the prostate cancer, or preventing the prostate cancer in the subject.

The methods of inducing an immune response or beating or preventing prostate cancer in a subject can comprise administering to the subject a therapeutically effective amount of a first vaccine comprising any of the disclosed self-replicating RNA molecules for priming the immune response ("prime vaccine"), and administering to the subject a therapeutically effective amount of a second vaccine comprising a GAd for boosting the immune response ("boost vaccine"), thereby inducing an immune response, beating the prostate cancer, or preventing the prostate cancer in the subject.

The methods of inducing an immune response or beating or preventing prostate cancer in a subject can comprise administering to the subject a therapeutically effective amount of a first vaccine comprising an MVA for priming the immune response ("prime vaccine"), and administering to the subject a therapeutically effective amount of a second vaccine comprising any of the disclosed self-replicating RNA molecules for boosting the immune response ("boost vaccine"), thereby inducing an immune response, beating the prostate cancer, or preventing the prostate cancer in the subject.

The methods of inducing an immune response or beating or preventing prostate cancer in a subject can comprise administering to the subject a therapeutically effective amount of a first vaccine comprising a Ad26 for priming the immune response ("prime vaccine"), and administering to the subject a therapeutically effective amount of a second vaccine comprising any of the disclosed self-replicating RNA molecules for boosting the immune response ("boost vaccine"), thereby inducing an immune response, beating the prostate cancer, or preventing the prostate cancer in the subject.

The methods of inducing an immune response or beating or preventing prostate cancer in a subject can comprise administering to the subject a therapeutically effective amount of a first vaccine comprising a GAd for priming the immune response ("prime vaccine"), and administering to the subject a therapeutically effective amount of a second vaccine comprising any of the disclosed self-replicating RNA molecules for boosting the immune response ("boost vaccine"), thereby inducing an immune response, beating the prostate cancer, or preventing the prostate cancer in the subject.

The methods of inducing an immune response, beating the prostate cancer, or preventing the prostate cancer in the subject can comprise administering to the subject a) a first vaccine ("prime vaccine") comprising a polynucleotide or RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; and b) a second vaccine ("boost vaccine") comprising a polynucleotide or RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177.

The methods of inducing an immune response, treating the prostate cancer, or preventing the prostate cancer in the subject can comprise administering to the subject a) a first vaccine ("prime vaccine") comprising a polynucleotide or RNA encoding a polypeptide selected from the group consisting of SEQ ID NOs: 541, 543, 550, 552, 554, 555, 556, 557, 558, 559, 623, 624, 625 or 626, and b) a second vaccine ("boost vaccine") comprising a polynucleotide or RNA encoding a polypeptide selected from the group consisting of SEQ ID NOs: 541, 543, 550, 552, 554, 555, 556, 557, 558, 559, 623, 624, 625 or 626.

The first vaccine ("prime vaccine") and the second vaccine ("boost vaccine") can be distinct recombinant viruses derived from GAd20, MVA, Ad26, or a self-replicating RNA molecule.

The first vaccine and the second vaccine can be capable of eliciting a cellular immune response in the subject. In some embodiments, the cellular immune response is specific against one or more fragments of the polypeptide of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 or 177, or any combination thereof. In some embodiments, the cellular immune response is specific against one or more fragments of the polypeptide of SEQ ID NOs: 541, 543, 550, 552, 554, 555, 556, 557, 558, 559, 623, 624, 625 or 626.

The cellular immune response can comprise activation of vaccine-specific $CD8^+$ T cells, $CD4^+$ T cells, or $CD8^+$ T cells and $CD4^+$ T cells, wherein activation is assessed by increased production of TNF$\alpha$, IFN$\gamma$, or TNF$\alpha$ and IFN$\gamma$ by $CD8^+$ T cells, $CD4^+$ T cells, or $CD8^+$ T cells and $CD4^+$ T cells.

The first vaccine ("prime vaccine"), the second vaccine ("boost vaccine"), or both the first vaccine ("prime vaccine") and the second vaccine ("boost vaccine") can be an RNA vaccine.

The first vaccine ("prime vaccine"), the second vaccine ("boost vaccine"), or both the first vaccine ("prime vaccine") and the second vaccine ("boost vaccine") can be a self-replicating RNA molecule.

The first vaccine ("prime vaccine") can be a recombinant virus derived from GAd20, Ad26, or MVA and the second vaccine ("boost vaccine") can be a self-replicating RNA molecule. In some embodiments, the first vaccine is Ad26. In some embodiments, the first vaccine is GAd20. In some embodiments, the first vaccine is MVA.

The first vaccine ("prime vaccine") can be a self-replicating RNA molecule and the second vaccine ("boost vaccine") can be a recombinant virus derived from Ad26, GAd20, or MVA. In some embodiments, the second vaccine is Ad26. In some embodiments, the second vaccine is GAd20. In some embodiments, the second vaccine is MVA.

The first vaccine ("prime vaccine") can be a recombinant virus derived from Ad26 comprising a polynucleotide encoding a polypeptide of SEQ ID NOs: 543, 552, 557, 558, 559, 625 or 626 and the second vaccine ("boost vaccine") can be a self-replicating RNA molecule comprising a polynucleotide encoding a polypeptide of SEQ ID NOs: 541, 543, 550, 552, 554, 555, 556, 557, 558, 559, 623, 624, 625 or 626.

The first vaccine ("prime vaccine") can be a recombinant virus derived from GAd20 comprising a polynucleotide encoding a polypeptide of SEQ ID NOs: 541, 550, 554, 555, 556, 623 or 624 and the second vaccine ("boost vaccine") can be a self-replicating RNA molecule comprising a polynucleotide encoding a polypeptide of SEQ ID NOs: 541, 543, 550, 552, 554, 555, 556, 557, 558, 559, 623, 624, 625 or 626.

The first vaccine ("prime vaccine") can be a recombinant virus derived from MVA comprising a polynucleotide encoding a polypeptide of SEQ ID NOs: 543, 552, 557, 558, 559, 625 or 626 and the second vaccine ("boost vaccine") can be a self-replicating RNA molecule comprising a polynucleotide encoding a polypeptide of SEQ ID NOs 541, 543, 550, 552, 554, 555, 556, 557, 558, 559, 623, 624, 625 or 626.

The first vaccine ("prime vaccine") can be a self-replicating RNA molecule comprising a polynucleotide encoding a polypeptide of SEQ ID NOs: 541, 543, 550, 552, 554, 555, 556, 557, 558, 559, 623, 624, 625 or 626 and the second vaccine ("boost vaccine") can be a recombinant virus derived from Ad26 comprising a polynucleotide encoding a polypeptide of SEQ ID NOs: 543, 552, 557, 558, 559, 625 or 626.

The first vaccine ("prime vaccine") can be a self-replicating RNA molecule comprising a polynucleotide encoding a polypeptide of SEQ ID NOs: 541, 543, 550, 552, 554, 555, 556, 557, 558, 559, 623, 624, 625 or 626 and the second vaccine ("boost vaccine") can be a recombinant virus derived from GAd20 comprising a polynucleotide encoding a polypeptide of SEQ ID NOs: 541, 550, 554, 555, 556, 623 or 624.

The first vaccine ("prime vaccine") can be a self-replicating RNA molecule comprising a polynucleotide encoding a polypeptide of SEQ ID NOs: 541, 543, 550, 552, 554, 555, 556, 557, 558, 559, 623, 624, 625 or 626 and the second vaccine ("boost vaccine") can be a recombinant virus derived from MVA comprising a polynucleotide encoding a polypeptide of SEQ ID NOs: 543, 552, 557, 558, 559, 625 or 626.

The self-replicating RNA molecule can be an alphavirus. In some embodiments, the alphavirus is derived from Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), and Buggy Creek virus. Virulent and avirulent alphavirus strains are both suitable. In some embodiments, the alphavirus RNA replicon is of a Sindbis virus (SIN), a Semliki Forest virus (SFV), a Ross River virus (RRV), a Venezuelan equine encephalitis virus (VEEV), or an Eastern equine encephalitis virus (EEEV). In some embodiments, the alphavirus is a Venezuelan equine encephalitis virus (VEEV).

The subject can have, can be suspected of having, or can be suspected to develop prostate cancer. In some embodiments, the prostate cancer is a relapsed prostate cancer, a refractory prostate cancer, a metastatic prostate cancer, a castration resistant prostate cancer, or any combination thereof. In some embodiments, the subject is treatment naïve. In some embodiments, the subject has received androgen deprivation therapy. In some embodiments, the subject has an elevated level of PSA.

The methods of inducing an immune response or treating or preventing prostate cancer in a subject can further comprise administering an additional cancer therapeutic agent to the subject. Suitable additional cancer therapeutic agents include a chemotherapy, an androgen deprivation therapy, radiation, a checkpoint inhibitor, a targeted therapy, or any combination thereof. The methods of treating and preventing prostate cancer in a subject can further comprise a surgery. In some embodiments, the additional cancer therapeutic agent is a CTLA-4 antibody, a CTLA4 ligand, a PD-1 axis inhibitor, a PD-L1 axis inhibitor, a TLR agonist, a CD40 agonist, an OX40 agonist, hydroxyurea, ruxolitinib, fedratinib, a 41BB agonist, a CD28 agonist, a STING antagonist, a RIG-1 antagonist, TCR-T therapy, CAR-T therapy, FLT3 ligand, aluminum sulfate, BTK inhibitor, CD38 antibody, CDK inhibitor, CD33 antibody, CD37 antibody, CD25 antibody, GM-CSF inhibitor, IL-2, IL-15, IL-7, CD3 redirection molecules, pomalimib, IFNγ, IFNα, TNFα, VEGF antibody, CD70 antibody, CD27 antibody, BCMA antibody or GPRC5D antibody or any combination thereof.

The checkpoint inhibitor can be ipilimumab, cetrelimab, pembrolizumab, nivolumab, sintilimab. cemiplimab, toripalimab, camrelizumab, tislelizumab, dostralimab, spartalizumab, prolgolimab, balstilimab, budigalimab, sasanlimab, avelumab, atezolizumab, durvalumab, envafolimab, or iodapolimab, or any combination thereof.

The first vaccine ("prime vaccine") can be administered one or more times to the subject. The second vaccine ("boost vaccine") can be administered one or more times to the subject. In some embodiments, the first vaccine is administered between about 1-16 weeks prior to administering the second vaccine. In some embodiments, the first vaccine is administered about 1 week prior to administering the second vaccine. In some embodiments, the first vaccine is administered about 2 weeks prior to administering the second vaccine. In some embodiments, the first vaccine is administered about 3 weeks prior to administering the second vaccine. In some embodiments, the first vaccine is administered about 4 weeks prior to administering the second vaccine. In some embodiments, the first vaccine is administered about 5 weeks prior to administering the second vaccine. In some embodiments, the first vaccine is administered about 6 weeks prior to administering the second vaccine. In some embodiments, the first vaccine is administered about 7 weeks prior to administering the second vaccine. In some embodiments, the first vaccine is administered about 8 weeks prior to administering the second vaccine. In some embodiments, the first vaccine is administered about 9 weeks prior to administering the second vaccine. In some embodiments, the first vaccine is administered about 10 weeks prior to administering the second vaccine. In some embodiments, the first vaccine is administered about 11 weeks prior to administering the second vaccine. In some embodiments, the first vaccine is administered about 12 weeks prior to administering the second vaccine. In some embodiments, the first vaccine is administered about 13 weeks prior to administering the second vaccine. In some embodiments, the first vaccine is administered about 14 weeks prior to administering the second vaccine. In some embodiments, the first vaccine is administered about 15 weeks prior to administering the second vaccine. In some embodiments, the first vaccine is administered about 16 weeks prior to administering the second vaccine.

The vaccines may be administered by intramuscular or subcutaneous injection. However, other modes of administration such as intravenous, cutaneous, intradermal or nasal can be envisaged as well. Intramuscular administration of the vaccines can be achieved by using a needle. An alternative is the use of a needleless injection device to administer the composition (using, e.g., Biojector™) or a freeze-dried powder containing the vaccine.

For intravenous, cutaneous, or subcutaneous injection, or injection at the site of affliction, the vaccine may be the form of a parenterally acceptable aqueous solution which is pyrogen-free and has suitable pH, isotonicity and stability. Those of skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required. A slow-release formulation may also be employed.

Typically, administration will have a prophylactic aim to generate an immune response against the prostate neoantigens before development of symptoms of prostate cancer.

The vaccines are administered to a subject, giving rise to an immune response in the subject. An amount of the vaccine to induce a detectable immune response is termed an "immunologically effective dose." The vaccines may induce a humoral as well as a cell-mediated immune response. The immune response can be a protective immune response.

The actual amount administered, and rate and time-course of administration, will depend on the nature and severity of what is being treated. Prescription of treatment, e.g., decisions on dosage etc., is within the responsibility of general practitioners and other medical doctors, and typically takes into account the disorder to be treated, the condition of the individual patient, the site of delivery, the method of administration and other factors known to practitioners.

In one exemplary regimen, the adenovirus is administered (e.g., intramuscularly) in a volume ranging between about 100 μL to about 10 ml containing concentrations of about $10^4$ to $10^{12}$ virus particles/ml. The adenovirus may be administered in a volume ranging between 0.25 and 1.0 ml, such as in a volume of 0.5 ml. The adenovirus may be administered in an amount of about $10^9$ to about $10^{12}$ viral particles (vp) to a human subject during one administration, more typically in an amount of about $10^{10}$ to about $10^{12}$ vp.

In one exemplary regimen, the MVA is administered (e.g., intramuscularly) in a volume ranging between about 100 μl to about 10 ml of saline solution containing a dose of about $1\times10^7$ $TCID_{50}$ to $1\times10^9$ $TCID_{50}$ (50% Tissue Culture Infective Dose) or Inf.U. (Infectious Unit). The MVA may be administered in a volume ranging between 0.25 and 1.0 ml.

Boosting vaccines may be administered two or more times, weeks or months after administration of the priming vaccine, for example, about 1 or 2 weeks, or 3 weeks, or 4 weeks, or 6 weeks, or 8 weeks, or 12 weeks, or 16 weeks, or 20 weeks, or 24 weeks, or 28 weeks, or 32 weeks, or one to two years after administration of the priming vaccine. Additional boosting vaccines may be administered 6 weeks to 5 years after the boosting step, such as 6, 7, 8, 9, 10, 11, 12, 13, 14, 15, 16, 17, 18, 19, 20, 21, 22, 23, 24, or 25 weeks, or 7, 8, 9, 10, 11, or 12 months, or 2, 3, 4, or 5 years, after the initial boosting inoculation. Optionally, the further boosting step can be repeated one or more times as needed.

The vaccines can be administered as part of a treatment cycle. In some embodiments, the treatment cycle comprises the administration of two doses of the vaccine to prime the immune response ("prime vaccine") and the administration of two doses of the vaccine to boost the immune response ("boost vaccine"). For example, a treatment cycle may comprise the administration of two doses of any of the disclosed GAd20, Ad26, MVA or self-replicating RNA molecule-based vaccines to prime the immune response and the administration of two doses of any of the disclosed GAd20, Ad26, MVA, or self-replicating RNA molecule-based vaccines to boost the immune response. Numerous treatment cycles can be administered. In some embodiments, 1, 2, 3, 4, 5, 6, 7, 8, 9, 10, or more than 10 treatment cycles can be administered. The treatment cycle(s) can be followed by one or more doses of boost vaccine ("further boost vaccine"). In some embodiments, the treatment cycle(s) are followed by 1, 2, 3, 4, 5, 6, 7, 8, 9, 10, or more than 10 further boost vaccines.

The prime vaccines can be administered 1 week, 2 weeks, 3 weeks, 4 weeks, or 5 weeks apart. The boost vaccines can be administered 1 week, 2 weeks, 3 weeks, 4 weeks, 5 weeks, 6 weeks, 7 weeks, 8 weeks, 9 weeks, 10 weeks, or more than 10 weeks from the prime vaccines. The boost vaccines can be administer 1 week, 2 weeks, 3 weeks, 4 weeks, 5 weeks, 6 weeks, 7 weeks, 8 weeks, 9 weeks, 10 weeks, or more than 10 weeks apart from the further boost vaccines.

Prostate Neoantigen Combinations for Vaccine Therapy

The disclosed neoantigens were validated and prioritized for their inclusion into a universal prostate cancer vaccine. The considerations for inclusion are, for example, higher expression in prostate cancer tissues vs. normal prostate tissue and other normal tissues (such as liver, kidney, pancreas, ovary, prostate, mammary gland, colon, stomach, skeletal muscle and lung), or undetectable expression in normal tissues, ability of the neoantigens or their fragments to mediate activation of $CD8^+$ T cells in known assays, binding to HLA, demonstrated in vivo processing and presentation to HLA of peptide fragments derived from the neoantigens, and sufficient prevalence in prostate cancer subjects.

Through the validation process, 41 neoantigens (SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23, and 177) were identified as particularly useful to be included into a prostate cancer vaccine based on their expression profile, prevalence, and in vitro immunogenicity. It is expected that any combination of the 41 neoantigens can be utilized to generate a prostate cancer vaccine that can be delivered to a subject utilizing any available delivery vehicle and any form available, such as peptides, DNA, RNA, replicons, or using viral delivery. The 41 neoantigens may be assembled into polynucleotides encoding polypeptides in any neoantigen order, and the neoantigen order may differ between the various delivery options. In general, assembly of the neoantigens into a particular order may be based on generating a minimum number of junctional epitopes utilizing known algorithms. Exemplary orders of the neoantigens are orders providing polypeptides of SEQ ID NOs: 541, 550, 554, 555, 556, 623, 624, 543, 552, 557, 558, 559, 625, or 626 as described herein and throughout the examples.

Disclosed herein are polypeptides comprising a TCE domain, a domain comprising an antigenic sequence, and a tag, wherein the TCE domain comprises the amino acid sequence of SEQ ID NO: 549;

the antigenic sequence comprises an amino acid sequence selected from the group consisting of SEQ ID NOs: 541, 543, 550, 552, 554, 555, 556, 557, 558, 559, 623, 624, 625, or 626; and the tag comprises the amino acid sequence of SEQ ID NO: 627.

In some embodiments, the polypeptides comprise:

the TCE domain comprising the amino acid sequence of SEQ ID NO: 549;

the antigenic sequence comprising an amino acid sequence of SEQ ID NO: 541; and the tag comprising the amino acid sequence of SEQ ID NO: 627.

In some embodiments, the polypeptides comprise:

the TCE domain comprising the amino acid sequence of SEQ ID NO: 549;

the antigenic sequence comprising an amino acid sequence of SEQ ID NO: 543; and the tag comprising the amino acid sequence of SEQ ID NO: 627.

Vaccines comprising the disclosed polypeptides are also provided. The vaccine can comprise a recombinant virus derived from GAd20, MV A, or Ad26, or a self-replicating RNA molecule. In some embodiments, the recombinant vims is derived from GAd20 and the polypeptide comprises the polypeptide of SEQ ID NO: 541. In some embodiments, the recombinant vims is derived from MVA and the polypeptide comprises the polypeptide of SEQ ID NO: 543. In some embodiments, the recombinant vims is derived from Ad26 and the polypeptide comprises the polypeptide of SEQ ID NO: 541 or 543. In some embodiments, the vaccine comprises a self-replicating RNA molecule comprising the polypeptide of SEQ ID NO: 541 or 543.

The disclosed polypeptides can be used to immunize an individual and to treat and/or prevent prostate cancer in a subject. The methods comprises administering to the individual any of the disclosed polypeptides or the vaccine comprising the polypeptides.

The vaccine can comprise a polynucleotide encoding a polypeptide, wherein the polypeptide comprises two or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof.

The vaccine can comprise a polynucleotide comprising two or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24 and 178, and fragments thereof.

In some embodiments, the fragments comprise polypeptides of SEQ ID NOs: 387, 388, 390, 392, 560, 561, 562, 563, 564, 565, 566, 567, 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 667, 668, 669, 670, 671, 672, 673, 674, 675, 676, 677, 678, 679, 680, 681, 682, 683, 684, 685, 686, 687, 688, 689, 690, 691, 692, 693, 694, 695, 696, 697, 698, 699, 700, 701, 702, 703, 704, 705, 706, 707, 708, 709, 710 or 711.

The vaccine can elicit a cellular immune response in a subject in which the vaccine was administered. In some embodiments, the cellular immune response is specific against a fragment of one or more polypeptides of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 or 177. In some embodiments, the cellular immune response is activation of vaccine-specific $CD8^+$ T cells, $CD4^+$ T cells, or $CD8^+$ T cells and $CD4^+$ T cells, wherein activation is assessed by increased production of TNFα, IFNγ, or TNFα and IFNγ by $CD8^+$ T cells, $CD4^+$ T cells, or $CD8^+$ T cells and $CD4^+$ T cells.

The polynucleotides can comprise a promoter, an enhancer, a polyadenylation site, a Kozak sequence, a stop codon, a T cell enhancer (TCE), or any combination thereof. In some embodiments, the promoter comprises a CMV promoter or a vaccinia P7.5 promoter. In some embodiments, the TCE is encoded by a polynucleotide of SEQ ID NO: 546, the CMV promoter comprises a polynucleotide of SEQ ID NO: 628, the vaccinia P7.5 promoter comprises a polynucleotide of SEQ ID NO: 630, and the polyadenylation site comprises a bovine growth hormone polyadenylation site of SEQ ID NO: 629.

The polypeptide can comprise an amino acid sequence of SEQ ID NOs: 541, 550, 554, 555, 556, 623, 624, 543, 552, 557, 558, 559, 625, or 626. In some embodiments, the polynucleotide comprises the polynucleotide sequence of SEQ ID NO: 544 or SEQ ID NO: 553. In some embodiments, the polynucleotide is DNA or RNA. In some embodiments, RNA is mRNA or self-replicating RNA.

The vaccine can comprise a polynucleotide encoding a polypeptide of SEQ ID NO: 541. The vaccine can comprise a polynucleotide encoding a polypeptide of SEQ ID NO: 550. The vaccine can comprise a polynucleotide encoding a polypeptide of SEQ ID NO: 554. The vaccine can comprise a polynucleotide encoding a polypeptide of SEQ ID NO: 555. The vaccine can comprise a polynucleotide encoding a polypeptide of SEQ ID NO: 556. The vaccine can comprise a polynucleotide encoding a polypeptide of SEQ ID NO: 623. The vaccine can comprise a polynucleotide encoding a polypeptide of SEQ ID NO: 624. The vaccine can comprise a polynucleotide encoding a polypeptide of SEQ ID NO: 543. The vaccine can comprise a polynucleotide encoding a polypeptide of SEQ ID NO: 552. The vaccine can comprise a polynucleotide encoding a polypeptide of SEQ ID NO: 557. The vaccine can comprise a polynucleotide encoding a polypeptide of SEQ ID NO: 558. The vaccine can comprise a polynucleotide encoding a polypeptide of SEQ ID NO: 559. The vaccine can comprise a polynucleotide encoding a polypeptide of SEQ ID NO: 625. The vaccine can comprise a polynucleotide encoding a polypeptide of SEQ ID NO: 626. The vaccine can comprise a polynucleotide of SEQ ID NO: 542. The vaccine can comprise a polynucleotide of SEQ ID NO: 551. The vaccine can comprise a polynucleotide of SEQ ID NOs: 544. The vaccine can comprise a polynucleotide of SEQ ID NOs: 553.

The vaccine can comprise a recombinant virus. In some embodiments, the recombinant virus is derived from adenovirus (Ad), poxvirus, adeno-associated virus (AAV), retrovirus or alphavirus. In some embodiments, the recombinant virus is derived from hAd5, hAd7, hAd11, hAd26, hAd34, hAd35, hAd48, hAd49, hAd50, GAd20, Gad19, GAd21, GAd25, GAd26, GAd27, GAd28, GAd29, GAd30, GAd31, ChAd3, ChAd4, ChAd5, ChAd6, ChAd7, ChAd8, ChAd9, ChAd10, ChAd11, ChAd16, ChAd17, ChAd19, ChAd20, ChAd22, ChAd24, ChAd26, ChAd30, ChAd31, ChAd37, ChAd38, ChAd44, ChAd55, ChAd63, ChAd73, ChAd82, ChAd83, ChAd146, ChAd147, PanAd1, PanAd2, PanAd3, Copenhagen vaccinia virus (W), New York Attenuated Vaccinia Virus (NYVAC), ALVAC, TROVAC, or modified vaccinia Ankara (MVA). In some embodiments, the recombinant virus is derived from GAd20. In some embodiments, the recombinant virus derived from GAd20 comprises a polynucleotide sequence of SEQ ID NO: 713. In some embodiments, the recombinant virus is derived from MVA. In some embodiments, the recombinant virus is derived from hAd26.

The vaccine can comprise a polynucleotide encoding a polypeptide of SEQ ID NO: 541, wherein the vaccine is a recombinant virus derived from GAd20. The vaccine can comprise a polynucleotide encoding a polypeptide of SEQ ID NO: 550, wherein the vaccine is a recombinant virus derived from GAd20. The vaccine can comprise a polynucleotide encoding a polypeptide of SEQ ID NO: 554, wherein the vaccine is a recombinant virus derived from GAd20. The vaccine can comprise a polynucleotide encoding a polypeptide of SEQ ID NO: 555, wherein the vaccine is a recombinant virus derived from GAd20. The vaccine can comprise a polynucleotide encoding a polypeptide of SEQ ID NO: 556, wherein the vaccine is a recombinant virus derived from GAd20. The vaccine can comprise a polynucleotide encoding a polypeptide of SEQ ID NO: 623, wherein the vaccine is a recombinant virus derived from GAd20. The vaccine can comprise a polynucleotide encoding a polypeptide of SEQ ID NO: 624, wherein the vaccine is a recombinant virus derived from GAd20. The vaccine can comprise a polynucleotide sequence of SEQ ID NO: 713, wherein the vaccine is a recombinant virus derived from GAd20. The vaccine can comprise a polynucleotide of SEQ ID NOs: 542, wherein the vaccine is a recombinant virus derived from GAd20. The vaccine can comprise a polynucleotide of SEQ ID NOs: 551, wherein the vaccine is a recombinant virus derived from GAd20.

The vaccine can comprise a polynucleotide encoding a polypeptide of SEQ ID NO: 543, wherein the vaccine is a recombinant virus derived from MVA. The vaccine can comprise a polynucleotide encoding a polypeptide of SEQ ID NO: 552, wherein the vaccine is a recombinant virus derived from MVA. The vaccine can comprise a polynucleotide encoding a polypeptide of SEQ ID NO: 557, wherein the vaccine is a recombinant virus derived from MVA. The vaccine can comprise a polynucleotide encoding a polypeptide of SEQ ID NO: 558, wherein the vaccine is a recombinant virus derived from MVA. The vaccine can comprise a polynucleotide encoding a polypeptide of SEQ ID NO: 559, wherein the vaccine is a recombinant virus derived from MVA. The vaccine can comprise a polynucleotide encoding a polypeptide of SEQ ID NO: 625, wherein the vaccine is a recombinant virus derived from MVA. The vaccine can comprise a polynucleotide encoding a polypeptide of SEQ ID NO: 626, wherein the vaccine is a recombinant virus derived from MVA. The vaccine can comprise a polynucleotide of SEQ ID NOs: 544, wherein the vaccine is a recombinant virus derived from MVA. The vaccine can comprise a polynucleotide of SEQ ID NOs: 553, wherein the vaccine is a recombinant virus derived from MVA.

The vaccine can comprise a recombinant virus derived from alphavirus species including Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), and Buggy Creek virus. Virulent and avirulent alphavirus strains are both suitable. In some embodiments, the alphavirus RNA replicon is of a Sindbis virus (SIN), a Semliki Forest virus (SFV), a Ross River virus (RRV), a Venezuelan equine encephalitis virus (VEEV), or an Eastern equine encephalitis virus (EEEV). In some embodiments, the recombinant virus is derived from VEEV.

The vaccine can comprise a self-replicating RNA molecule comprising a RNA encoding a polypeptide of SEQ ID NO: 541, wherein the vaccine is a recombinant virus derived from VEEV. The vaccine can comprise a self-replicating RNA molecule comprising a RNA encoding a polypeptide of SEQ ID NO: 543, wherein the vaccine is a recombinant virus derived from VEEV. The vaccine can comprise a self-replicating RNA molecule comprising a RNA encoding a polypeptide of SEQ ID NO: 550, wherein the vaccine is a recombinant virus derived from VEEV. The vaccine can comprise a self-replicating RNA molecule comprising a RNA encoding a polypeptide of SEQ ID NO: 552, wherein the vaccine is a recombinant virus derived from VEEV. The vaccine can comprise a self-replicating RNA molecule comprising a RNA encoding a polypeptide of SEQ ID NO: 554, wherein the vaccine is a recombinant virus derived from VEEV. The vaccine can comprise a self-replicating RNA molecule comprising a RNA encoding a polypeptide of SEQ ID NO: 555, wherein the vaccine is a recombinant virus derived from VEEV. The vaccine can comprise a self-replicating RNA molecule comprising a RNA encoding a polypeptide of SEQ ID NO: 556, wherein the vaccine is a recombinant virus derived from VEEV. The vaccine can comprise a self-replicating RNA molecule comprising a RNA encoding a polypeptide of SEQ ID NO: 557, wherein the vaccine is a recombinant virus derived from VEEV. The vaccine can comprise a self-replicating RNA molecule comprising a RNA encoding a polypeptide of SEQ ID NO: 558, wherein the vaccine is a recombinant virus derived from VEEV. The vaccine can comprise a self-replicating RNA molecule comprising a RNA encoding a polypeptide of SEQ ID NO: 559, wherein the vaccine is a recombinant virus derived from VEEV. The vaccine can comprise a self-replicating RNA molecule comprising a RNA encoding a polypeptide of SEQ ID NO: 623, wherein the vaccine is a recombinant virus derived from VEEV. The vaccine can comprise a self-replicating RNA molecule comprising a RNA encoding a polypeptide of SEQ ID NO: 624, wherein the vaccine is a recombinant virus derived from VEEV. The vaccine can comprise a self-replicating RNA molecule comprising a RNA encoding a polypeptide of SEQ ID NO: 625, wherein the vaccine is a recombinant virus derived from VEEV. The vaccine can comprise a self-replicating RNA molecule comprising a RNA encoding a polypeptide of SEQ ID NO: 626, wherein the vaccine is a recombinant virus derived from VEEV.

The methods of treating or preventing a prostate cancer in a subject can comprise administering to the subject a therapeutically effective amount of a vaccine comprising a recombinant virus derived from GAd20 comprising a polynucleotide encoding a polypeptide of SEQ ID NOs: 541, 550, 554, 555, 556, 623 or 624. The methods of beating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 541. The methods of beating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 550. The methods of beating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 554. The methods of beating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 555. The methods of beating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 556. The methods of treating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 623. The methods of treating or preventing a prostate cancer in a subject can comprise administering to the subject a therapeutically effective amount of a vaccine comprising a recombinant virus derived from GAd20 comprising a polynucleotide encoding a polypeptide of SEQ ID NO: 624.

The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NOs: 543, 552, 557, 558, 559, 625 or 626. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 543. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 552. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 557. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 558. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 559. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 625. The methods of treating or preventing a prostate cancer in a subject can comprise administering to the subject a therapeutically effective amount of a vaccine comprising a recombinant virus derived from MVA comprising a polynucleotide encoding a polypeptide of SEQ ID NO: 626.

The methods of treating or preventing a prostate cancer in a subject can comprise administering to the subject a therapeutically effective amount of a vaccine comprising a self-replicating RNA molecule derived from VEEV comprising a RNA encoding a heterologous polypeptide of SEQ ID NOs: 541, 543, 550, 552, 554, 555, 556, 557, 558, 559, 623, 624, 625 or 626. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 541. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 543. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 550. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 552. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 554. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 555. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 556. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 557. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 558. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 559. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 623. The methods of treating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 624. The methods of treating or preventing a prostate cancer in a subject can comprise administering to the subject a therapeutically effective amount of a vaccine comprising a recombinant virus derived from VEEV comprising a polynucleotide encoding a polypeptide of SEQ ID NOs: 625. The methods of beating or preventing a prostate cancer in a subject can comprise administering to the subject a therapeutically effective amount of a vaccine comprising a self-replicating RNA molecule derived from VEEV comprising a RNA encoding a polynucleotide encoding a polypeptide of SEQ ID NOs: 626.

The use of a vaccine comprising a recombinant virus derived from GAd20 comprising a polynucleotide encoding a polypeptide of SEQ ID NOs: 541, 550, 554, 555, 556, 623 or 624 for the preparation of a medicament for beating or preventing a prostate cancer is also provided. In some embodiments, the GAd20 comprises a polynucleotide encoding a polypeptide of SEQ ID NO: 541. In some embodiments, the GAd20 comprises a polynucleotide encoding a polypeptide of SEQ ID NO: 550. In some embodiments, the GAd20 comprises a polynucleotide encoding a polypeptide of SEQ ID NO: 554. In some embodiments, the GAd20 comprises a polynucleotide encoding a polypeptide of SEQ ID NO: 555. In some embodiments, the GAd20 comprises a polynucleotide encoding a polypeptide of SEQ ID NO: 556. In some embodiments, the GAd20 comprises a polynucleotide encoding a polypeptide of SEQ ID NO: 623. In some embodiments, the GAd20 comprises a polynucleotide encoding a polypeptide of SEQ ID NO: 624.

The use of a vaccine comprising a recombinant virus derived from MVA comprising a polynucleotide encoding a polypeptide of SEQ ID NOs: 543, 552, 557, 558, 559, 625 or 626 for the preparation of a medicament for beating or preventing a prostate cancer is also provided. In some embodiments, the MVA comprises a polynucleotide encoding a polypeptide of SEQ ID NO: 543. In some embodiments, the MVA comprises a polynucleotide encoding a polypeptide of SEQ ID NO: 552. In some embodiments, the MVA comprises a polynucleotide encoding a polypeptide of SEQ ID NO: 557. In some embodiments, the MVA comprises a polynucleotide encoding a polypeptide of SEQ ID NO: 558. In some embodiments, the MVA comprises a polynucleotide encoding a polypeptide of SEQ ID NO: 559. In some embodiments, the MVA comprises a polynucleotide encoding a polypeptide of SEQ ID NO: 625. In some embodiments, the MVA comprises a polynucleotide encoding a polypeptide of SEQ ID NO: 626.

The use of a vaccine comprising a self-replicating RNA molecule derived from VEEV comprising an RNA encoding a polypeptide of SEQ ID NOs: 541, 543, 550, 552, 554, 555, 556, 557, 558, 559, 623, 624, 625 or 626 for the preparation of a medicament for treating or preventing a prostate cancer is also provided. In some embodiments, the self-replicating RNA molecule derived from VEEV comprises an RNA encoding a polypeptide of SEQ ID NOs: 541. In some embodiments, the self-replicating RNA molecule derived from VEEV comprises an RNA encoding a polypeptide of SEQ ID NOs: 543. In some embodiments, the self-replicating RNA molecule derived from VEEV comprises an RNA encoding a polypeptide of SEQ ID NOs: 550. In some embodiments, the self-replicating RNA molecule derived from VEEV comprises an RNA encoding a polypeptide of SEQ ID NOs: 552. In some embodiments, the self-replicating RNA molecule derived from VEEV comprises an RNA encoding a polypeptide of SEQ ID NOs: 554. In some embodiments, the self-replicating RNA molecule derived from VEEV comprises an RNA encoding a polypeptide of SEQ ID NOs: 555. In some embodiments, the self-replicating RNA molecule derived from VEEV comprises an RNA encoding a polypeptide of SEQ ID NOs: 556. In some embodiments, the self-replicating RNA molecule derived from VEEV comprises an RNA encoding a polypeptide of SEQ ID NOs: 557. In some embodiments, the self-replicating RNA molecule derived from VEEV comprises an RNA encoding a polypeptide of SEQ ID NOs: 558. In some embodiments, the self-replicating RNA molecule derived from VEEV comprises an RNA encoding a polypeptide of SEQ ID NOs: 559. In some embodiments, the self-replicating RNA molecule derived from VEEV comprises an RNA encoding a polypeptide of SEQ ID NOs: 623. In some embodiments, the self-replicating RNA molecule derived from VEEV comprises an RNA encoding a polypeptide of SEQ ID NOs: 624. In some embodiments, the self-replicating RNA molecule derived from VEEV comprises an RNA encoding a polypeptide of SEQ ID NOs: 625. In some embodiments, the self-replicating RNA molecule derived from VEEV comprises an RNA encoding a polypeptide of SEQ ID NOs: 626.

Also provided is a vaccine comprising a recombinant virus derived from GAd20 comprising a polynucleotide encoding a polypeptide of SEQ ID NOs: 541, 550, 554, 555, 556, 623 or 624 for use in treating or preventing a prostate cancer. In some embodiments, the GAd20 comprises a polynucleotide encoding a polypeptide of SEQ ID NO: 541. In some embodiments, the GAd20 comprises a polynucleotide encoding a polypeptide of SEQ ID NO: 550. In some embodiments, the GAd20 comprises a polynucleotide encoding a polypeptide of SEQ ID NO: 554. In some embodiments, the GAd20 comprises a polynucleotide encoding a polypeptide of SEQ ID NO: 555. In some embodiments, the GAd20 comprises a polynucleotide encoding a polypeptide of SEQ ID NO: 556. In some embodiments, the GAd20 comprises a polynucleotide encoding a polypeptide of SEQ ID NO: 623. In some embodiments, the GAd20 comprises a polynucleotide encoding a polypeptide of SEQ ID NO: 624.

Also provided is a vaccine comprising a recombinant virus derived from MVA comprising a polynucleotide encoding a polypeptide of SEQ ID NOs: 543, 552, 557, 558, 559, 625 or 626 for use in treating or preventing a prostate cancer. In some embodiments, the MVA comprises a polynucleotide encoding a polypeptide of SEQ ID NO: 543. In some embodiments, the MVA comprises a polynucleotide encoding a polypeptide of SEQ ID NO: 552. In some embodiments, the MVA comprises a polynucleotide encoding a polypeptide of SEQ ID NO: 557. In some embodiments, the MVA comprises a polynucleotide encoding a polypeptide of SEQ ID NO: 558. In some embodiments, the MVA comprises a polynucleotide encoding a polypeptide of SEQ ID NO: 559. In some embodiments, the MVA comprises a polynucleotide encoding a polypeptide of SEQ ID NO: 625. In some embodiments, the MVA comprises a polynucleotide encoding a polypeptide of SEQ ID NO: 626.

Also provided is a vaccine comprising a self-replicating RNA molecule comprising an RNA corresponding to a polynucleotide encoding a polypeptide of SEQ ID NOs: 541, 543, 550, 552, 554, 555, 556, 557, 558, 559, 623, 624, 625 or 626 for use in treating or preventing a prostate cancer. In some embodiments, the self-replicating RNA molecule comprises an RNA corresponding to a polynucleotide encoding a polypeptide of SEQ ID NOs: 541. In some embodiments, the self-replicating RNA molecule comprises an RNA corresponding to a polynucleotide encoding a polypeptide of SEQ ID NOs: 543. In some embodiments, the self-replicating RNA molecule comprises an RNA corresponding to a polynucleotide encoding a polypeptide of SEQ ID NOs: 550. In some embodiments, the self-replicating RNA molecule comprises an RNA corresponding to a polynucleotide encoding a polypeptide of SEQ ID NOs: 552. In some embodiments, the self-replicating RNA molecule comprises an RNA corresponding to a polynucleotide encoding a polypeptide of SEQ ID NOs: 554. In some embodiments, the self-replicating RNA molecule comprises an RNA corresponding to a polynucleotide encoding a polypeptide of SEQ ID NOs: 555. In some embodiments, the self-replicating RNA molecule comprises an RNA corresponding to a polynucleotide encoding a polypeptide of SEQ ID NOs: 556. In some embodiments, the self-replicating RNA molecule comprises an RNA corresponding to a polynucleotide encoding a polypeptide of SEQ ID NOs: 557. In some embodiments, the self-replicating RNA molecule comprises an RNA corresponding to a polynucleotide encoding a polypeptide of SEQ ID NOs: 558. In some embodiments, the self-replicating RNA molecule comprises an RNA corresponding to a polynucleotide encoding a polypeptide of SEQ ID NOs: 559. In some embodiments, the self-replicating RNA molecule comprises an RNA corresponding to a polynucleotide encoding a polypeptide of SEQ ID NOs: 623. In some embodiments, the self-replicating RNA molecule comprises an RNA corresponding to a polynucleotide encoding a polypeptide of SEQ ID NOs: 624. In some embodiments, the self-replicating RNA molecule comprises an RNA corresponding to a polynucleotide encoding a polypeptide of SEQ ID NOs: 625. In some embodiments, the self-replicating RNA molecule comprises an RNA corresponding to a polynucleotide encoding a polypeptide of SEQ ID NOs: 626.

The vaccine comprising a recombinant virus derived from GAd20 can be administered as a prime. The vaccine comprising a recombinant virus derived from MVA can be administered as a boost. The vaccine comprising a self-replicating RNA molecule can be administered as a boost.

In some embodiments, the vaccine comprising the polynucleotide sequence encoding a polypeptide of SEQ ID NOs: 541 or 550 is administered as a prime.

In some embodiments, the vaccine comprising the polynucleotide sequence encoding a polypeptide of SEQ ID NOs 543 or 552 is administered as a boost.

In some embodiments, the vaccine comprising the polynucleotide sequence encoding a polypeptide of SEQ ID NOs 541, 543, 550, 552, 554, 555, 556, 557, 558, 559, 623, 624, 625 or 626 is administered as a boost.

The methods of treating or preventing a prostate cancer in a subject can comprise:

- administering to the subject a therapeutically effective amount of a vaccine comprising a polynucleotide encoding a polypeptide comprising two, three, four, five, six, seven, eight, nine, ten, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or 41 polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof as a prime; and
- administering to the subject a therapeutically effective amount of a vaccine comprising a polynucleotide encoding a polypeptide comprising two, three, four, five, six, seven, eight, nine, ten, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, or 41 polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof as a boost; thereby treating or preventing the prostate cancer in the subject.

The methods of treating or preventing a prostate cancer in a subject can comprise administering to the subject:

a first vaccine comprising a first polynucleotide encoding a first polypeptide, wherein the first polypeptide comprises two or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; and a second vaccine comprising a second polynucleotide encoding a second polypeptide, wherein the second polypeptide comprises two or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177.

The methods of treating or preventing a prostate cancer in a subject can comprise administering to the subject:

a first vaccine comprising a first polynucleotide encoding a first polypeptide, wherein the first polypeptide comprises two or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; and a second vaccine comprising a second polynucleotide encoding a second polypeptide, wherein the second polypeptide comprises two or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; wherein the first polypeptide and the second polypeptide have distinct amino acid sequences.

The polypeptides can be organized in a first order and in a second order. In some embodiments, the polypeptides organized in the first order comprise a polypeptide of SEQ ID NO: 541, 543, 550, 552, 554, 555, 556, 557, 558, 559, 623, 624, 625 or 626. In some embodiments, the polypeptides organized in the first order comprises a polypeptide of SEQ ID NO: 541 or SEQ ID NO: 550. In some embodiments, the polypeptides organized in the second order comprises a polypeptide of SEQ ID NO: 543 or SEQ ID NO: 552. In some embodiments, the polypeptides organized in the first order comprises a polypeptide of SEQ ID NO: 542, 551, 544, or 553.

The methods of treating or preventing a prostate cancer in a subject can comprise administering to the subject:

a first vaccine comprising a first polynucleotide encoding a first polypeptide, wherein the first polypeptide comprises an amino acid sequence of SEQ ID NOs: 541, 550, 554, 555, 556, 623 or 624; and a second vaccine comprising a second polynucleotide encoding a second polypeptide, wherein the second polypeptide comprises the amino acid sequence of SEQ ID NOs: 543, 552, 557, 558, 559, 625 or 626.

The methods of treating or preventing a prostate cancer in a subject can comprise administering to the subject:

a first vaccine comprising a first polynucleotide encoding a first polypeptide, wherein the first polypeptide comprises an amino acid sequence of SEQ ID NO: 541; and a second vaccine comprising a second polynucleotide encoding a second polypeptide, wherein the second polypeptide comprises the amino acid sequence of SEQ ID NO: 543.

Combination Therapies

The disclosed vaccines may be used in combination with at least one additional cancer therapeutic agent for treating prostate cancer. The additional cancer therapeutic agent may be a chemotherapy, an androgen deprivation therapy, radiation therapy, targeted therapy or a checkpoint inhibitor, or any combination thereof. The disclosed vaccines may also be used in combination with surgery.

Exemplary chemotherapeutic agents are alkylating agents; nitrosoureas; antimetabolites; antitumor antibiotics; plant alkyloids; taxanes; hormonal agents; and miscellaneous agents, such as busulfan, carboplatin, chlorambucil, cisplatin, cyclophosphamide, dacarbazine, ifosfamide, mechlorethamine hydrochloride, melphalan, procarbazine, thiotepa, uracil mustard, 5-fluorouracil, 6-mercaptopurine, capecitabine, cytosine arabinoside, floxuridine, fludarabine, gemcitabine, methotrexate, thioguanine, dactinomycin, daunorubicin, doxorubicin, idarubicin, mitomycin-C, and mitoxantrone, vinblastine, vincristine, vindesine, vinorelbine, paclitaxel, docetaxel.

Exemplary androgen deprivation therapies include abiraterone acetate, ketoconazole, enzalutamide, galeterone, ARN-509 and orteronel (TAK-700) and surgical removal of the testicles.

Radiation therapy may be administered using various methods, including external-beam therapy, internal radiation therapy, implant radiation, stereotactic radiosurgery, systemic radiation therapy, radiotherapy and permanent or temporary interstitial brachytherapy. External-beam therapy involves three-dimensional, conformal radiation therapy where the field of radiation is designed, local radiation (e.g., radiation directed to a preselected target or organ), or focused radiation. Focused radiation may be selected from stereotactic radiosurgery, fractionated stereotactic radiosurgery or intensity-modulated radiation therapy. Focused radiation may have particle beam (proton), cobalt-60 (photon) linear accelerator (x-ray) as a radiation source (see e.g. WO 2012/177624). "Brachytherapy," refers to radiation therapy delivered by a spatially confined radioactive material inserted into the body at or near a tumor or other proliferative tissue disease site, and includes exposure to radioactive isotopes (e.g., At-211, I-131, I-125, Y-90, Re-186, Re-188, Sm-153, Bi-212, P-32, and radioactive isotopes of Lu). Suitable radiation sources for use as a cell conditioner include both solids and liquids. The radiation source can be a radionuclide, such as I-125, I-131, Yb-169, Ir-192 as a solid source, I-125 as a solid source, or other radionuclides that emit photons, beta particles, gamma radiation, or other therapeutic rays. The radioactive material may also be a fluid made from any solution of radionuclide(s), e.g., a solution of I-125 or I-131, or a radioactive fluid can be produced using a slurry of a suitable fluid containing small particles of solid radionuclides, such as Au-198, Y-90. The radionuclide(s) may be embodied in a gel or radioactive micro spheres.

Targeted therapies include anti-androgen therapies, inhibitors of angiogenesis such as bevacizumab, anti-PSA or anti-PSMA antibodies or vaccines enhancing immune responses to PSA or PSMA.

Exemplary checkpoint inhibitors are antagonists of PD-1, PD-L1, PD-L2, VISTA, BTNL2, B7-H3, B7-H4, HVEM, HHLA2, CTLA-4, LAG-3, TIM-3, BTLA, CD160, CEACAM-1, LAIR1, TGFβ, IL-10, Siglec family protein, KIR, CD96, TIGIT, NKG2A, CD112, CD47, SIRPA or CD244. A molecule is an antagonist when the at least one reaction or activity is suppressed by at least about 30%, 40%, 45%, 50%, 55%, 60%, 65%, 70%, 75%, 80%, 85%, 90%, 95%, or 100% more than the at least one reaction or activity suppressed in the absence of the antagonist (e.g., negative control), or when the suppression is statistically significant when compared to the suppression in the absence of the antagonist. Antagonist may be an antibody, a soluble ligand, a small molecule, a DNA or RNA such as siRNA. Exemplary antagonists of checkpoint inhibitors are described in U.S. Pat. Publ. No. 2017/0121409.

In some embodiments, one or more of the disclosed vaccines is administered in combination with a CTLA-4 antibody, a CTLA4 ligand, a PD-1 axis inhibitor, a PD-L1 axis inhibitor, a TLR agonist, a CD40 agonist, an OX40 agonist, hydroxyurea, ruxolitinib, fedratinib, a 41BB agonist, aa CD28 agonist, a STING antagonist, a RIG-1 antagonist, TCR-T therapy, CAR-T therapy, FLT3 ligand, aluminum sulfate, BTK inhibitor, CD38 antibody, CDK inhibitor, CD33 antibody, CD37 antibody, CD25 antibody, GM-CSF inhibitor, IL-2, IL-15, IL-7, CD3 redirection molecules, pomalimib, IFNγ, IFNα, TNFα, VEGF antibody, CD70 antibody, CD27 antibody, BCMA antibody or GPRC5D antibody, any combination thereof.

In some embodiments, the checkpoint inhibitor is ipilimumab, cetrelimab, pembrolizumab, nivolumab, sintilimab. cemiplimab, toripalimab, camrelizumab, tislelizumab, dostralimab, spartalizumab, prolgolimab, AK-105, HLX-10, balstilimab, MEDI-0680, HX-008, GLS-010, BI-754091, genolimzumab, AK-104, MGA-012, F-520, 609A, LY-3434172, AMG-404, SL-279252, SCT-I10A, RO-7121661, ICTCAR-014, MEDI-5752, CS-1003, XmAb-23104, Sym-021, LZM-009, hAB21, BAT-1306, MGD-019, JTX-4014, budigalimab, XmAb-20717, AK-103, MGD-013, IBI-318, sasanlimab, CC-90006, avelumab, atezolizumab, durvalumab, CS-1001, bintrafusp alpha, envafolimab, CX-072, GEN-1046, GS-4224, KL-A167, BGB-A333, SHR-1316, CBT-502, IL-103, KN-046, ZKAB-001, CA-170, TG_1501, LP-002, INCB-86550, ADG-104, SHR-1701, BCD-135, IMC-001, MSB-2311, FPT-155, FAZ-053, HLX-20, iodapolimab, FS-118, BMS-986189, AK-106, MCLA-145, IBI-318 or CK-301, or any combination thereof.

In some embodiments, one or more of the disclosed vaccines are administered in combination with ipilimumab, cetrelimab, pembrolizumab, nivolumab, sintilimab. cemiplimab, toripalimab, camrelizumab, tislelizumab, dostralimab, spartalizumab, prolgolimab, balstilimab, budigalimab, sasanlimab, avelumab, atezolizumab, durvalumab, envafolimab or iodapolimab, or any combination thereof.

Kits

Also disclosed herein are kits comprising one or more of the disclosed vaccines.

The disclosed kits can comprise one or more of the disclosed recombinant viruses. The kits may be used to facilitate performing the methods described herein. In some embodiments, the kit further comprises reagents to facilitate entry of the vaccines of the disclosure into a cell, such as lipid-based formulations or viral packaging materials.

In some embodiments, the kit comprises any of the disclosed Ad26 viruses. In some embodiments, the kit comprises any of the disclosed MVA viruses. In some embodiments, the kit comprises any of the disclosed GAd viruses. In some embodiments, the kit comprises any of the disclosed Ad26 viruses and any of the disclosed MVA viruses. In some embodiments, the kit comprises any of the disclosed GAd viruses and any of the disclosed MVA viruses. In some embodiments, the kit comprises any of the disclosed Ad26 viruses and any of the disclosed GAd viruses. In some embodiments, the kit comprises any of the disclosed self-replicating RNA molecules and any of the disclosed GAd viruses. In some embodiments, the kit comprises any of the disclosed self-replicating RNA molecules and any of the disclosed MVA viruses. In some embodiments, the kit comprises any of the disclosed self-replicating RNA molecules and any of the disclosed Ad26 viruses. In some embodiments, the kit comprises one or more of the disclosed polynucleotides. In some embodiments, the kit comprises one or more of the disclosed polypeptides. In some embodiments, the kit comprises one or more of the disclosed vectors. In some embodiment, the kit comprises one or more of the disclosed cells.

EXAMPLES

The following examples are provided to further describe some of the embodiments disclosed herein. The examples are intended to illustrate, not to limit, the disclosed embodiments.

Example 1. General Methods

Peptide Synthesis

Peptides were synthesized by New England Peptide with purity >80%. The lyophilized peptides were solubilized in 100% DMSO.

Immunogenicity

The immunogenicity of a protein or peptide can be determined by a number of assays known to persons of ordinary skill, for example immunostaining of intracellular cytokines or secreted cytokines by epitope-specific T-cell populations, or by quantifying frequencies and total numbers of epitope-specific T-cells and characterizing their differentiation and activation state, e.g. short-lived effector and memory precursor effector CD8+ T-cells. Immunogenicity can also be determined by measuring an antibody-mediated immune response, e.g. the production of antibodies by measuring serum IgA or IgG titers.

In Vitro Immunogenicity Assessment of Neoantigens ("Patient PBMC Restimulation Assay")

PBMCs from human patients with metastatic castrate-resistant prostate cancer were thawed using media (RPMI 1640 supplemented with Glutamax, 10% HI FBS, and IX Sodium Pyruvate). Cells were counted and plated in a 96 well round bottom microplate at a concentration of 250,000 viable cells per well. Lyophilized peptides were solubilized in 100% DMSO and diluted in media to 10 μg/mL. Neoantigen peptides were added in equal volume to PBMCs for a final concentration of 5 μg/mL. CEF Peptide Pool "Plus" (Cellular Technologies, Ltd.) was utilized as a positive control and DMSO at the same final concentration as the experimental peptides was utilized as a negative control. Human IL-15 (Peprotech) was added to all wells at final concentration of 10 ng/mL.

Plates were incubated at 37° C. (5% $CO_2$) for a total of 13 days. Media was refreshed every 2 days with IL-15 (10 ng/mL final concentration) and IL-2 (R&D systems, 10 IU/mL final concentration). On day 12, PBMCs were restimulated with identical experimental peptides or controls, at same concentration as peptide stimulation on Day 1. After 1-hour incubation, protein Inhibitor Cocktail (eBioscience) was added to every well and plate was incubated overnight.

On day 13, cells were stained for intracellular flow cytometry analysis. The cells were washed with PBS and stained with Live/Dead Fixable Aqua Dead Cell stain (ThermoFisher). Following the live/dead stain, cells were blocked using Biotin-Free Fc Receptor Blocker (Accurate Chemical & Scientific Corp). Extracellular cellular flow panel (1 μL/antibody per well in 50 μL) consisted of CD3 PerCP-Cy5.5 (Biolegend), CD4 BV421 (Biolegend), and CD8 APC-Cy7 (Biolegend). After extracellular staining, cells were fixed using Foxp3/Transcription Factor Staining Buffer Set (eBioscience) and stained for intracellular proteins (1:50 dilution) using TNFα FITC (R&D Systems) and IFNγ BV785 (Biolegend). Cells were washed and resuspended in stain buffer and analyzed using a BD Celesta flow cytometer.

Flow cytometry cell staining analysis was completed using Flow Jo v10. Cells were gated on live, singlet, CD3+ cells. The CD8+ T cells were analyzed for TNFα/IFNγ expression and the frequency of double positive TNFα/IFNγ CD8+ T cells was recorded. Responses were assessed to be positive when the frequency of double positive TNFα/IFNγ CD8+ T cells due to stimulation with an experimental peptide was increased greater than or equal to 2-fold over the DMSO only negative control for that patient. Peptides were analyzed in 1 to 7 patient samples.

In Vitro Immunogenicity Assessment of Neoantigens ("Exogenous Autologous Normal Donor Restimulation Assay")

CD1c+ Dendritic Cells (DC) isolated from human normal PBMCs were thawed using media (IMDM (Gibco) supplemented with glutamine, HEPES, 5% human serum (Sigma), and IX Pen-Strep). DC cells were resuspended in media supplemented with IL-4 (Peprotech, 80 ng/mL) and GM-CSF (Gibco, 80 ng/mL), plated in 6 well microplates, and rested overnight at 37° C. (5% $CO_2$). The following day, DC cells were counted and plated in a 96 well round bottom microplate at a concentration of 30,000 viable cells per well. Lyophilized peptides (15-mer overlapping peptides) were solubilized in 100% DMSO and pooled by neoantigen to between 5 mg/mL and 20 mg/mL. Neoantigen peptides pools were added to DCs for a final concentration of 2.5 μg/mL to 10 μg/mL and rested for 2 hours at 37° C. (5% $CO_2$). CEF Peptide Pool "Plus" (Cellular Technologies, Ltd.) was utilized as a positive control and DMSO at the same final concentration as the experimental peptides was utilized as a negative control. After 2 hours, DC cells were irradiated with 50 gray of ionizing radiation. Autologous CD3+ Pan-T cells isolated from human normal PBMCs were thawed using media. Following irradiation, autologous Pan-T cells were added to the irradiated DCs at 300,000 viable cells per well. Human IL-15 (Peprotech) was added to all wells at final concentration of 10 ng/mL.

Plates were incubated at 37° C. (5% $CO_2$) for a total of 12 days. Media was refreshed every 2-3 days with IL-15 (10 ng/mL final concentration) and IL-2 (R&D systems, 10 IU/mL final concentration). On day 11 cells were re-stimulated with identical experimental peptide pools or controls, at same concentration as peptide stimulation on Day 1. Protein Inhibitor Cocktail (eBioscience) was added to every well and plate was incubated overnight at 37° C. (5% $CO_2$).

On day 12, cells were stained for intracellular flow cytometry analysis. The cells were washed with PBS and stained with Live/Dead Fixable Aqua Dead Cell stain (ThermoFisher). Following the live/dead stain, cells were blocked using Biotin-Free Fc Receptor Blocker (Accurate Chemical & Scientific Corp). Extracellular cellular flow panel (1 μL/antibody per well in 50 μL) consisted of CD3 PerCP-Cy5.5 (Biolegend), CD4 BV421 (Biolegend), and CD8 APC-Cy7 (Biolegend). After extracellular staining, cells were fixed using Foxp3/Transcription Factor Staining Buffer Set (eBioscience) and stained for intracellular proteins (1:50 dilution) using TNFα FITC (R&D Systems) and IFNγ BV785 (Biolegend). Cells were washed and resuspended in stain buffer and analyzed using a BD Celesta flow cytometer.

Flow cytometry cell staining analysis was completed using FlowJo v10. Cells were gated on live, singlet, CD3+ cells. The CD8+ and CD4+ T cells were analyzed for TNFα/IFNγ expression and the frequency of double positive TNFα/IFNγ CD8+ and the frequency of double positive TNFα/IFNγ CD4+ T cells were recorded. Responses were assessed to be positive when the frequency of double positive TNFα/IFNγ CD8+ or TNFα/IFNγ CD4+ T cells due to stimulation with an experimental peptide pool was increased greater than or equal to 3-fold over the DMSO only negative control for that donor and at least 0.01%.

In Vitro Endogenous Immunogenicity Assessment of Neoantigens ("Endogenous Autologous Normal Donor Restimulation Assay")

CD1c+ Dendritic Cells (DC) isolated from human normal PBMCs were thawed using media (IMDM (Gibco) supplemented with glutamine, HEPES, 5% human serum (Sigma), and IX Pen-Strep). DC cells were resuspended in media supplemented with IL-4 (Peprotech, 80 ng/mL) and GM-CSF (Gibco, 80 ng/mL), plated in 6 well microplates, and rested overnight at 37° C. (5% $CO_2$). The following day, DC cells were counted and plated in a 96 well round bottom microplate at a concentration of 30,000 viable cells per well. Ad5 vectors (Vector Biolabs) were dilute in media to an MOI (Multiplicity Of Infection) of 5000 based on Plaque Forming Units. Ad5 vectors for the CEF pool and a "null" were used as controls. DCs were transduced with Ad5 vectors overnight at 37° C. (5% $CO_2$). The following day, the Ad5 vectors were washed off the plate by three sequential centrifugation/aspiration steps using sterile Phosphate Buffered Saline. After the final wash, transduced DCs were resuspended in 100 μL media. Autologous CD3+ Pan-T cells isolated from human normal PBMCs were thawed using media. Pan-T cells were added to the irradiated DCs at 300,000 viable cells per well (100 μL/well). Human IL-15 (Peprotech) was added to all wells at final concentration of 10 ng/mL.

Plates were incubated at 37° C. (5% $CO_2$) for a total of 12 days. Media was refreshed every 2-3 days with IL-15 (10 ng/mL final concentration) and IL-2 (R&D systems, 10 IU/mL final concentration). On day 11 lyophilized peptides (15-mer overlapping peptides) were solubilized in 100% DMSO and pooled by neoantigen to between 5 mg/mL and 20 mg/mL. Neoantigen peptides pools were added to cells for a final concentration of 2.5 μg/mL to 10 μg/mL. CEF Peptide Pool "Plus" (Cellular Technologies, Ltd.) was utilized as a positive control and DMSO at the same final concentration as the experimental peptides was utilized as a negative control. Protein Inhibitor Cocktail (eBioscience) was added to every well and plate was incubated overnight at 37° C. (5% $CO_2$).

On day 12, cells were stained for intracellular flow cytometry analysis. The cells were washed with PBS and stained with Live/Dead Fixable Aqua Dead Cell stain (ThermoFisher). Following the live/dead stain, cells were blocked using Biotin-Free Fc Receptor Blocker (Accurate Chemical & Scientific Corp). Extracellular cellular flow panel (1 μL/antibody per well in 50 μL) consisted of CD3 PerCP-Cy5.5 (Biolegend), CD4 BV421 (Biolegend), and CD8

APC-Cy7 (Biolegend). After extracellular staining, cells were fixed using Foxp3/Transcription Factor Staining Buffer Set (eBioscience) and stained for intracellular proteins (1:50 dilution) using TNFα FITC (R&D Systems) and IFNγ BV785 (Biolegend). Cells were washed and resuspended in stain buffer and analyzed using a BD Celesta flow cytometer.

Flow cytometry cell staining analysis was completed using Flow Jo v10. Cells were gated on live, singlet, CD3+ cells. The CD8+ and CD4+ T cells were analyzed for TNFα/IFNγ expression and the frequency of double positive TNFα/IFNγ CD8+ and the frequency of double positive TNFα/IFNγ CD4+ T cells were recorded. Responses were assessed to be positive when the frequency of double positive TNFα/IFNγ CD8+ or TNFα/IFNγ CD4+ T cells due to stimulation with an experimental peptide pool was increased greater than or equal to 3-fold over the DMSO only negative control for that donor and at least 0.01%.

In Vitro Binding of Neoantigens to Class I MHC

The 9 mer peptides identified by bioinformatics analysis were analyzed for their binding propensities to 6 common HLA class I alleles (HLA-A*01:01, A*02:01, A*03:01, A*24:02, B*07:02, B*08:01). The principle of the method is briefly described below and consists of two parts, one involving exchange of peptide with a positive control induced by Ultraviolet (UV) radiation, and the second is an enzyme immunoassay to detect stable HLA-peptide and empty HLA complexes. HLA-bound peptides are critical for the stability of the HLA complex. A conditional HLA class I complex was stabilized by an UV-labile peptide utilizing a different peptide (Pos) for each HLA (Pos: HLA-A*01:01: CTELKLSDY(SEQ ID NO: 409), HLA-A*02:01: NLVPMVATV (SEQ ID NO: 410), HLA-A*03:01: LIYRRRLMK (SEQ ID NO: 411), HLA-A*24:02: LYSACFWWL (SEQ ID NO: 412), HLA-B*07:02: NPKASLLSL (SEQ ID NO: 413), HLA-B*08:01: ELRSRYWAI (SEQ ID NO: 414), which could be cleaved by UV irradiation when bound to the HLA molecule. Upon cleavage, the resulting peptide fragments dissociated from the HLA class I complex since their length was insufficient to bind stably to HLA. Under the conditions in which peptide cleavage was performed (neutral pH, on melting ice), the peptide-free HLA complex remained stable. Thus, when cleavage was performed in the presence of another HLA class I peptide of choice, this reaction resulted in net exchange of the cleaved UV-labile peptide Pos with the chosen peptide (Rodenko, B et al. (2006) Nature Protocols 1: 1120-32, Toebes, M et al. (2006) Nat Med 12: 246-51, Bakker, A H et al. (2008) Proc Natl Acad Sci USA 105: 3825-30).

The exchange efficiency between the peptide of interest and Pos was analyzed using an HLA class I ELISA. The combined technologies allowed the identification of ligands for an HLA molecule of interest which are potentially immunogenic.

Exchange control peptide Pos was a high affinity binder to the relevant HLA class I allele while exchange control peptide Neg was a non-binder. The UV control represented UV-irradiation of conditional HLA class I complex in the absence of a rescue peptide. The binding of exchange control peptide Neg (HLA-A*01:01: NPKASLLSL (SEQ ID NO: 413), HLA-A*02-01: IVTDLSVIK (SEQ ID NO: 416), HLA-A*03:01: NPKASLLSL (SEQ ID NO: 413), HLA-A*24:02: NLVPMVATV (SEQ ID NO: 410), HLA-B*07:02: LIYRRRLMK (SEQ ID NO: 411), HLA-B*08:01: NLVPMVATV (SEQ ID NO: 410) and all experimental peptides were evaluated relative to that of exchange control peptide Pos. The absorption of the latter peptide was set at 100%. This procedure resulted in a range of different exchange percentages that reflected the affinities of the different experimental peptides for the HLA allele used.

The HLA class I ELISA is an enzyme immunoassay based on the detection of beta2-microglobulin (B2M) of (peptide-stabilized) HLA class I complexes. To this end streptavidin was bound onto polystyrene microtiter wells. After washing and blocking, HLA complex present in exchange reaction mixtures or ELISA controls was captured by the streptavidin on the microtiter plate via its biotinylated heavy chain. Non-bound material was removed by washing. Subsequently, horseradish peroxidase (HRP)-conjugated antibody to human B2M was added. The HRP-conjugated antibody binds only to an intact HLA complex present in the microtiter well because unsuccessful peptide exchange results in disintegration of the original UV-sensitive HLA complex upon UV illumination. In the latter case B2M was removed during the washing step. After removal of non-bound HRP conjugate by washing, a substrate solution was added to the wells. A colored product formed in proportion to the amount of intact HLA complex present in the samples. After the reaction was terminated by the addition of a stop solution, absorbance was measured in a microtiter plate reader. The absorbance was normalized to the absorbance of an exchange control peptide (represents 100%). Suboptimal HLA binding of peptides with a moderate to low affinity for HLA class I molecules can also be detected by this ELISA technique (Rodenko, B et al. (2006) Nature Protocols 1: 1120-32).

Peptides that had 10% or greater exchange efficiency in one of the 6 HLA alleles were considered for further immunogenicity testing and analysis.

Example 2. Identification of Neoantigens by Bioinformatics

A computational framework was developed to analyze various prostate cancer RNA-seq datasets by bioinformatics means to identify common prostate cancer neoantigens resulting from aberrant transcriptional programs such as gene fusion events, intron retention, alternatively spliced variants and aberrant expression of developmentally silenced genes.

The datasets queried were:

The Genotype-Tissue Expression (GTEx) Consortium. This dataset encompasses 6137 RNA-seq datasets from 49 normal tissues and was used to annotate RNA features in normal tissues and assess frequency of potential prostate neoantigen candidates in normal tissue.

The Cancer Genome Atlas Prostate Adenocarcinoma (TCGA PRAD) (Cancer Genome Atlas Research Network. Cell. 2015 Nov. 5; 163 (4): 1011-25. doi: 10.1016/j.cell.2015.10.025). This dataset encompasses RNA-seq datasets from 508 prostate cancer subjects and was used to identity neoantigen candidates in localized prostate adenocarcinoma.

Stand Up To Cancer (SU2C) (Robinson D et al., Cell. 2015 May 21; 161 (5): 1215-1228. doi: 10.1016/j.cell.2015.05.001). This dataset encompasses RNA-seq datasets from 43 mCRPC subjects.

Quality control (QC) of raw data was conducted prior to analysis. Sequencing reads were first trimmed to remove Illumina's adapter sequences and reads mapping to human tRNA and rRNA were removed from downstream analysis. Reads were also trimmed of bases with poor base quality score (<10, PHRED scale; indicating a base with a 1 in 10 probability of being incorrect) at either ends. PHRED quality score measures the quality of the identification of the bases generated by automated DNA sequencing instruments. Trimmed reads with less than 25 bps were removed from the datasets. Additionally, following QC steps were considered to remove poor quality reads: remove reads having maximal base quality PHRED score of <15, remove reads with average base quality PHRED score of <10, remove reads having polyATCG rate >80%, remove RNA sequences in which one of the two reads failed.

Reads that passed the QC criteria were mapped to Human Genome Build 38 using ArrayStudio ((wwwomicsoftcom/array-studio/) platform. Refseq gene model (release date Jun. 6, 2017) was used for annotation of novel RNA features.

The results published here are in whole or part based upon data generated by The Cancer Genome Atlas managed by the NCI and NHGRI. Information about TCGA can be found at http://_cancergenme_nih_gov.

Identification of Gene Fusion Events

FusionMap algorithm (Ge H et al., Bioinformatics. 2011 Jul. 15; 27(14): 1922-8. doi: 10.1093/bioinformatics/btr310. Epub 2011 May 18) was used to identify gene fusion events in the prostate cancer datasets described above. FusionMap detects fusion junctions based on seed reads which contain the fusion breakpoint position in the middle region of the reads. The algorithm dynamically creates a pseudo fusion transcript/sequence library based on the consensus of mapped fusion junctions from the seed reads. FusionMap then aligns unmapped possible fusion reads to the pseudo fusion reference to further identify rescued reads. The program reports a list of detected fusion junctions, statistics of supporting reads, fusion gene pairs, as well as genomic locations of breakpoints and junction sequences, which characterize fusion genes comprehensively at base-pair resolution.

Figure 2:
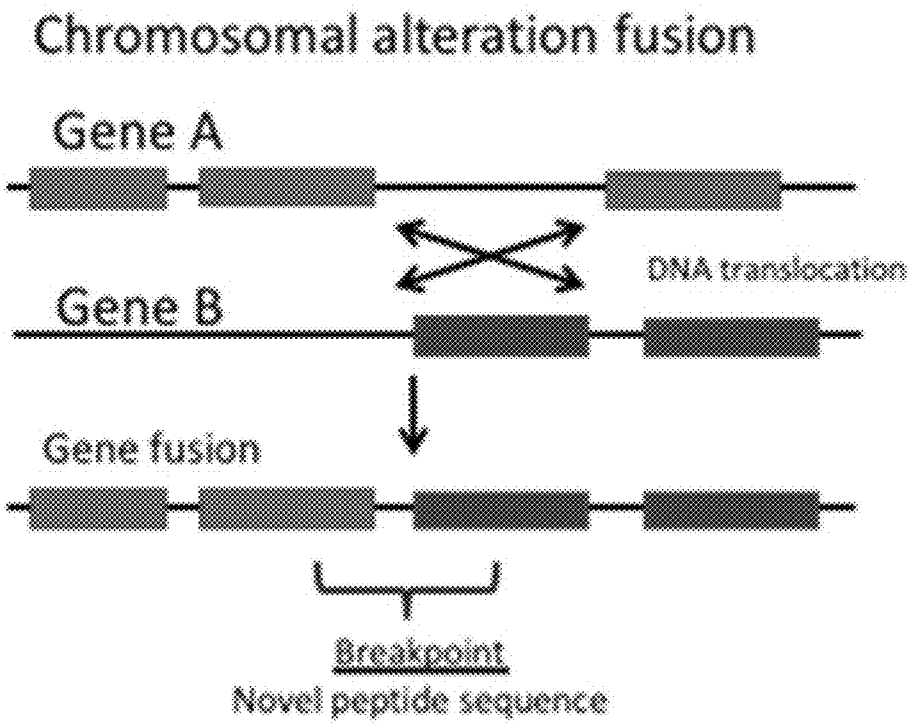
FIG. 2 depicts an exemplary gene fusion resulting from chromosomal alteration, such as DNA translocations.

Neoantigens originating from chimeric read-through fusions as shown in FIG. 1 and fusions resulting from chromosomal alterations as shown in FIG. 2 were identified using FusionMap. Neoantigens were classified as originating from gene fusion events when following criteria were met: fusion junction was supported by at least two seed reads with different mapping positions in the genome, at least 4 sequencing reads (seed and rescued reads) parsing the junction, and at least one junction spanning read. The prevalence of neoantigens were queried in tumor tissue and normal tissue using the datasets mentioned above. Neoantigens were identified as common when the prevalence was identified to be >10% in at least one disease cohort (TCGA and SU2C) and <2% in normal tissue (6137 RNA-seq datasets from 49 normal tissues). Gene fusion events with less than 10% prevalence in disease cohort were included if they generated long stretches of novel peptide sequences or were present in genes of interest.

Identification of Splice Variants

Figure 3:
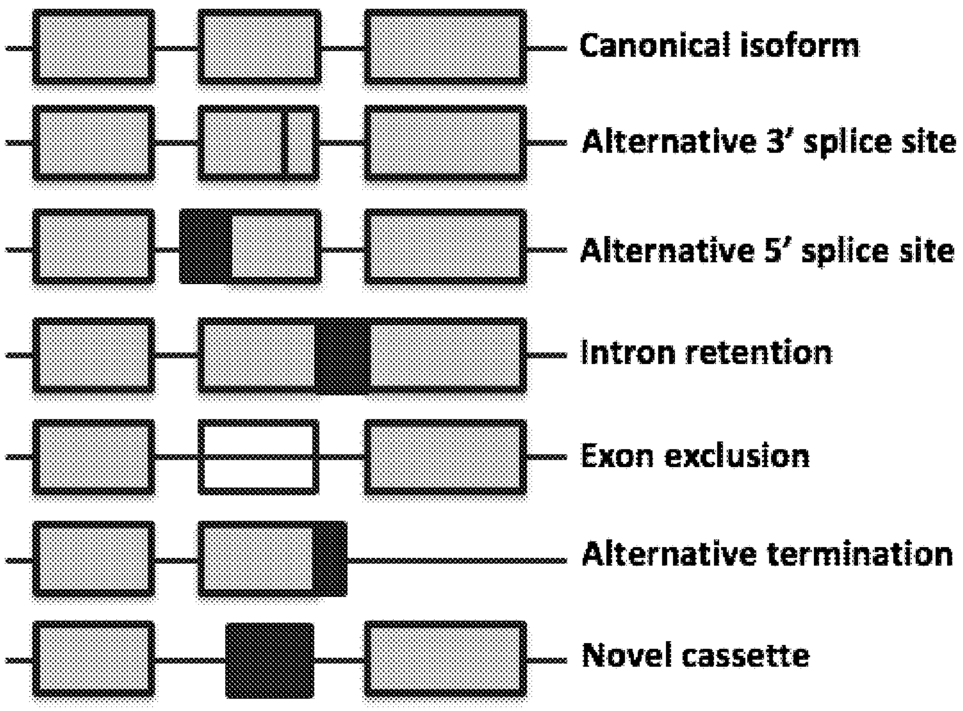
FIG. 3 depicts exemplary splice variants with alternative 5' or 3' splice sites, retained introns, excluded exons or alternative terminations or insertions.
Figure 4:
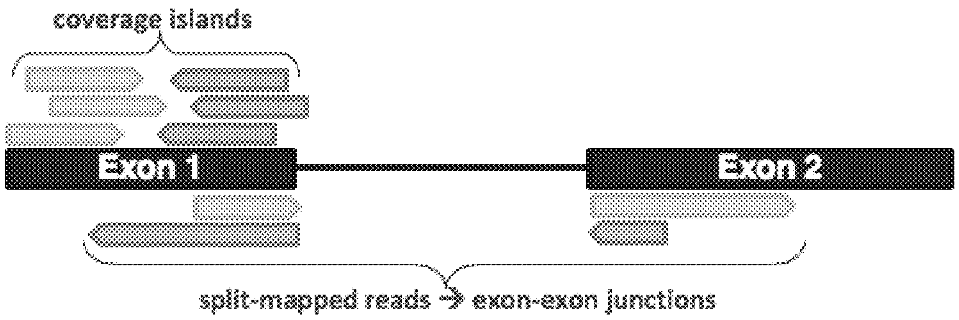
FIG. 4 depicts an exemplary approach for the identification of splice variants.

A custom bioinformatic software was developed to analyze paired-end RNA-seq data to identify potential neoantigens arising from alternative splicing events. Utilizing the developed process, splice variants with alternative 5' or 3' splice sites, retained introns, excluded exons, alternative terminations or insertion(s) of novel cassettes as show in in FIG. 3 were identified. The process identified splice variants that were not present in the RefSeq gene model through two main functionalities: 1) Identification of novel junctions based on reads with gaps of 6 or more bp and sequences of at least 15 bp aligned on each side of the gap, henceforth referred to as split-mapped reads. Novel junctions were reported if they were represented by at least 5 split-mapped reads and one mate pair of reads flanking the junction on each end. 2) Identification of islands of aligned reads, henceforth referred to as coverage islands. Further details on parameters used for determining island boundaries are described below. FIG. 4 shows the cartoon of the approach.

In order to differentiate reads mapping to intronic regions due to true splicing variation as opposed to genomic DNA and/or pre-mRNA contamination, two parameters were developed to establish the distribution of contamination across 200 highly expressed housekeeping genes. The tail ends of these distributions were then used as cut-offs for discovery of novel splice variants where relevant.

1. Intron depth of coverage (IDC): $90^{th}$ percentile depth of coverage for all housekeeping intronic bases. If the coverage of a particular region fell below this value, the first base where this occurred was defined as a coverage island boundary.
2. Intron/exon coverage ratio (IECR): $90^{th}$ percentile of the ratio between median intron coverage and median coverage of the nearest upstream exon of all housekeeping gene introns All reported splice variants were required to meet the following criteria:

Alternative 375' Splice Site Identification:

- Novel splice site was supported by at least 5 split-mapped reads and one mate pair of reads flanking the junction
- Intronic region resulting from using the splice site (if applicable) exceeded IECR and entire region exceeded IDC Novel Cassette Identification:

- Two novel splice sites in an intronic region were supported by at least 5 split-mapped reads and one mate pair of reads flanking the junction
- Region between the two splice sites exceeded IECR and entire region exceeded IDC Intron Retention Identification:

- Intronic region exceeded IECR and entire region exceeded IDC
- At least 5 reads span both intron-exon boundaries, with at least 15 bp aligned on each side of the boundaries Alternative Termination Identification:

- 3' boundary defined as the edge of a coverage island that did not fall within 60 bp of the 3' end of a canonical exon
- Any intronic regions between 5' end of a canonical exon and the 3' boundary exceeded IECR and entire region exceeded IDC Exon Exclusion Identification:

- Novel junction was supported by at least 5 split-mapped reads and one mate pair of reads flanking the junction where one or more canonical exons were skipped Neoantigens derived from aberrant splicing events were identified as common when the incidence was identified to be about >10% in disease cohort (TCGA and SU2C datasets) and about <1% in normal tissue (GTEx Consortium dataset).

Identification of DNA Mutations (Point and Frameshift) Based Neoantigens

The TCGA, SU2C and the integrated DFCI/Sloane Kettering datasets (Integrated DFCI/Sloane Kettering dataset (Armenia et al., Nat Genet. 2018 May; 50(5):645-651. doi: 10.1038/s41588-018-0078-z. Epub 2018 Apr. 2) as described above containing exome sequencing data from patients with prostate cancer were examined. Mutation calls published by the consortia that generated these datasets were downloaded, and gene mutations that were present in >10% of the patient population or in genes known to be drivers of prostate cancer (such as AR) were identified. For each single point mutation chosen, a 17 mer peptide with the mutated amino acid at its center was identified for further validation studies.

Splicing Isoform Prediction

In certain cases, there were multiple reading frames and exons upstream of the identified splicing events that could impact the canonical peptide sequence preceding the neoepitope sequence. In these genes, it was determined which canonical exons neighbored each neoepitope feature based on the split-mapped reads present at the exon boundaries. The most highly expressed isoform with the highest average expression in the disease cohort with the highest prevalence of the event that could contain the predicted neoepitope was chosen for translation into the corresponding protein by choice of the open reading frame associated with the isoform. The neoepitope portion of the protein sequence was extracted, with an additional 8 amino acid residues upstream of the first altered amino acid included and used for subsequent validation studies. A similar procedure was followed to identify putative immunogenic antigens from DNA frameshift alterations. For both frameshift deletions and insertions, the resulting DNA sequence was translated into the corresponding protein by choice of the appropriate open reading frame, and the frameshift altered portion of the protein sequence was extracted, with an additional 8 amino acid residues upstream of the first altered amino acid included.

Table 1 shows the gene origin, the specific mutation, the amino acid sequences of identified neoantigens with single amino acid mutations (M) and frequency in patients. Each mutation is bolded in Table 1. Table 2 shows their corresponding polynucleotide sequences. The mutant sequences are capitalized in Table 2. Patient frequency (%) in Table 1 was obtained from Armenia et al., *Nat Genet* 50(5): 645-651, 2018.

TABLE 1

| Neoepitope ID | Gene | Mutation | Patient Frequency (%) | Amino acid sequence | SEQ ID NO: |
|---|---|---|---|---|---|
| M1 | TP53 | R248Q | 1.0859 | SSCMGGMN**Q**RPILTIIT | 1 |
| M2 | TP53 | R248W | 0.0987 | SSCMGGMN**W**RPILTIIT | 3 |
| M3 | TP53 | R273C | 0.6910 | LGRNSFEV**C**VCACPGRD | 5 |
| M4 | TP53 | R273L | 0.3949 | LGRNSFEV**L**VCACPGRD | 7 |
| M5 | TP53 | G245S | 0.6910 | MCNSSCMG**S**MNRRPILT | 9 |
| M6 | TP53 | Y220C | 0.4936 | FRHSVVVP**C**EPPEVGSD | 11 |
| M7 | TP53 | R282W | 0.4936 | VCACPGRD**W**RTEEENLR | 13 |
| M8 | SPOP | F133C | 0.5923 | FVQGKDWG**C**KKFIRRDF | 15 |
| M9 | SPOP | F133I | 0.3949 | FVQGKDWG**I**KKFIRRDF | 17 |
| M10 | SPOP | F133L | 1.1846 | FVQGKDWG**L**KKFIRRDF | 19 |
| M11 | SPOP | F133S | 0.3949 | FVQGKDWG**S**KKFIRRDF | 21 |
| M12 | SPOP | F133V | 0.9872 | FVQGKDWG**V**KKFIRRDF | 23 |
| M13 | SPOP | W131C | 0.0987 | YRFVQGKD**C**GFKKFIRR | 25 |
| M14 | SPOP | W131G | 1.2833 | YRFVQGKD**G**GFKKFIRR | 27 |
| M15 | SPOP | W131L | 0.1974 | YRFVQGKD**L**GFKKFIRR | 29 |
| M16 | SPOP | W131R | 0.1974 | YRFVQGKD**R**GFKKFIRR | 31 |
| M17 | SPOP | W131S | 0.0987 | YRFVQGKD**S**GFKKFIRR | 33 |
| M18 | KMT2D | R5214H | 0.1974 | YPVGYEAT**H**IYWSLRTN | 35 |
| M19 | FOXA1 | R261C | 0.1974 | MFENGCYL**C**RQKRFKCE | 37 |
| M20 | FOXA1 | H247Q | 0.1974 | GKGSYWTL**Q**PDSGNMFE | 39 |
| M21 | FOXA1 | H247L | 0.0987 | GKGSYWTL**L**PDSGNMFE | 41 |
| M22 | FOXA1 | H247N | 0.0987 | GKGSYWTL**N**PDSGNMFE | 43 |
| M23 | FOXA1 | H247Y | 0.0987 | GKGSYWTL**Y**PDSGNMFE | 45 |
| M24 | FOXA1 | F266C | 0.0987 | CYLRRQKR**C**KCEKQPGA | 47 |
| M25 | FOXA1 | F266S | 0.0987 | CYLRRQKR**S**KCEKQPGA | 49 |
| M26 | FOXA1 | D226G | 0.0987 | IRHSLSFN**G**CFVKVARS | 51 |
| M27 | FOXA1 | D226N | 0.1974 | IRHSLSFN**N**CFVKVARS | 53 |

TABLE 1-continued

| Neoepitope ID | Gene | Mutation | Patient Frequency (%) | Amino acid sequence | SEQ ID NO: |
|---|---|---|---|---|---|
| M28 | FOXA1 | R219C | 0.0987 | QQRWQNSI**C**HSLSFNDC | 55 |
| M29 | FOXA1 | R219S | 0.1974 | QQRWQNSI**S**HSLSFNDC | 57 |
| M30 | FOXA1 | M253K | 0.1974 | TLHPDSGN**K**FENGCYLR | 59 |
| M31 | FOXA1 | M253R | 0.0987 | TLHPDSGN**R**FENGCYLR | 61 |
| M32 | CDK12 | R858W | 0.1974 | CHKKNFLH**W**DIKCSNIL | 63 |
| M33 | PTEN | R130Q | 0.2962 | IHCKAGKG**Q**TGVMICAY | 65 |
| M34 | PTEN | V119F | 0.1974 | WLSEDDNH**F**AAIHCKAG | 67 |
| M35 | ATM | N2875S | 0.0987 | GLGDRHVQ**S**ILINEQSA | 69 |
| M36 | ATM | N2875K | 0.0987 | GLGDRHVQ**K**ILINEQSA | 71 |
| M37 | KDM6A | C1164S | 0.0987 | NINIGPGD**S**EWFVVPEG | 73 |
| M38 | KDM6A | C1164Y | 0.0987 | NINIGPGD**Y**EWFVVPEG | 75 |
| M39 | PIK3CA | H1047R | 0.4936 | FMKQMNDA**R**HGGWTTKM | 77 |
| M40 | PIK3CA | E545K | 0.2962 | RDPLSEIT**K**QEKDFLWS | 79 |
| M41 | PIK3CA | E545G | 0.0987 | RDPLSEIT**G**QEKDFLWS | 81 |
| M42 | PIK3CA | E545A | 0.0987 | RDPLSEIT**A**QEKDFLWS | 83 |
| M43 | CTNNB1 | T41A | 0.4936 | SGIHSGAT**A**TAPSLSGK | 85 |
| M44 | CTNNB1 | D32A | 0.0987 | HWQQQSYL**A**SGIHSGAT | 87 |
| M45 | CTNNB1 | D32H | 0.0987 | HWQQQSYL**H**SGIHSGAT | 89 |
| M46 | CTNNB1 | D32V | 0.0987 | HWQQQSYL**V**SGIHSGAT | 91 |
| M47 | CTNNB1 | D32Y | 0.1974 | HWQQQSYL**Y**SGIHSGAT | 93 |
| M48 | CTNNB1 | S37A | 0.0987 | SYLDSGIH**A**GATTTAPS | 95 |
| M49 | CTNNB1 | S37C | 0.0987 | SYLDSGIH**C**GATTTAPS | 97 |
| M50 | CTNNB1 | S37F | 0.0987 | SYLDSGIH**F**GATTTAPS | 99 |
| M51 | CTNNB1 | S37Y | 0.0987 | SYLDSGIH**Y**GATTTAPS | 101 |
| M52 | CTNNB1 | S45C | 0.0987 | SGATTTAP**C**LSGKGNPE | 103 |
| M53 | CTNNB1 | S45F | 0.0987 | SGATTTAP**F**LSGKGNPE | 105 |
| M54 | CTNNB1 | S45P | 0.0987 | SGATTTAP**P**LSGKGNPE | 107 |
| M55 | COL5A1 | T348K | 0.1974 | YVPSEDYY**K**PSPYDDLT | 109 |
| M56 | TAF1L | A869T | 0.1974 | IRKRLKLC**T**DFKRTGMD | 111 |
| M57 | MED12 | L1224F | 0.7897 | VDGAVFAV**F**KAVFVLGD | 113 |
| M58 | MED12 | V1223G | 0.0987 | IVDGAVFA**G**LKAVFVLG | 115 |
| M59 | MED12 | V1223L | 0.0987 | IVDGAVFA**L**LKAVFVLG | 117 |
| M60 | MGA | R2435W | 0.1974 | THTANERR**W**RGEMRDLF | 119 |
| M61 | ARID1A | P1756R | 0.1974 | GRFSKVSS**R**APMEGGEE | 121 |
| M62 | CUL3 | M299R | 0.4936 | GKTEDLGC**R**YKLFSRVP | 123 |
| M63 | USP7 | Q4H | 0.4936 | MNH**H**QQQQQKA | 125 |
| M64 | SF3B1 | K700E | 0.1974 | HGLVDEQQ**E**VRTISALA | 127 |
| M65 | U2AF1 | S34F | 0.2962 | VCRHGDRC**F**RLHNKPTF | 129 |

TABLE 1-continued

| Neoepitope ID | Gene | Mutation | Patient Frequency (%) | Amino acid sequence | SEQ ID NO: |
|---|---|---|---|---|---|
| M66 | CDC27 | Y73C | 0.1974 | SCTTPQCK**C**LLAKCCVD | 131 |
| M67 | CDC27 | N260H | 0.1974 | SILSKQVQ**H**KPKTGRSL | 133 |
| M68 | BRAF | G469A | 0.2962 | QRIGSGSF**A**TVYKGKWH | 135 |
| M69 | BRAF | K601E | 0.1974 | GDFGLATV**E**SRWSGSHQ | 137 |
| M70 | RAG1 | R112C | 0.0987 | QANLRHLC**C**ICGNSFRA | 139 |
| M71 | RAG1 | R112H | 0.1974 | QANLRHLC**H**ICGNSFRA | 141 |
| M72 | CNOT3 | E20K | 0.3949 | DRCLKKVS**K**GVEQFEDI | 143 |
| M73 | CNOT3 | E70K | 0.2962 | IKTWVASN**K**IKDKRQLI | 145 |
| M74 | PIK3 | E1051K | 0.2962 | QKFDEALR**K**SWTTKVNW | 147 |
| M75 | IDH1 | R132C | 0.1974 | WVKPIIIG**C**HAYGDQYR | 149 |
| M76 | IDH1 | R132G | 0.0987 | WVKPIIIG**G**HAYGDQYR | 151 |
| M77 | IDH1 | R132H | 0.4936 | WVKPIIIG**H**HAYGDQYR | 153 |
| M78 | KRAS | G12D | 0.1974 | YKLVVVGA**D**GVGKSALT | 155 |
| M79 | KRAS | G12R | 0.2962 | YKLVVVGA**R**GVGKSALT | 157 |
| M80 | KRAS | Q61K | 0.2962 | LDILDTAG**K**EEYSAMRD | 159 |
| M81 | KRAS | Q61L | 0.0987 | LDILDTAG**L**EEYSAMRD | 161 |
| M82 | KRAS | Q61R | 0.0987 | LDILDTAG**R**EEYSAMRD | 163 |
| M83 | AKT1 | E17K | 0.4936 | EGWLHKRG**K**YIKTWRPR | 165 |
| M84 | AR | T878A | 1.2833 | IARELHQFAFDLLIKSH | 167 |
| M85 | AR | T878G | 0.0987 | IARELHQF**G**FDLLIKSH | 169 |
| M86 | AR | L702H | 1.0859 | QPDSFAALHSSLNELGE | 171 |
| M87 | AR | W742L | 0.1974 | QMAVIQYSLMGLMVFAM | 173 |
| M88 | AR | W742F | 0.0987 | QMAVIQYSFMGLMVFAM | 175 |

TABLE 2

| Neoepitope ID | Polynucleotide sequence | SEQ ID NO: |
|---|---|---|
| M1 | agacctgcatgggcggcatgaaccAgaggcccatcctcaccatcatcaca | 2 |
| M2 | agttcctgcatgggcggcatgaaTTggaggcccatcctcaccatcatcaca | 4 |
| M3 | ctgggacggaacagctttgaggtgTgtgtttgtgcctgtcctgggagagac | 6 |
| M4 | ctgggacggaacagctttgaggtgcTtgtagtgcctgtcctgggagagac | 8 |
| M5 | atgtgtaacagttcctgcatgggcAgcatgaaccggaggcccatcctcacc | 10 |
| M6 | tttcgacatagtgtggtggtgccctGtgagccgcctgaggttggctctgac | 12 |
| M7 | gtttgtgcctgtcctgggagagaTTggcgcacagaggaagagaatctccgc | 14 |
| M8 | tttgtgcaaggcaaagactggggatGcaagaaattcatccgtagagatttt | 16 |
| M9 | tttgtgcaaggcaaagactggggaAtcaagaaattcatccgtagagatttt | 18 |
| M10 | tttgtgcaaggcaaagactggggattAaagaaattcatccgtagagatttt | 20 |
| M11 | tttgtgcaaggcaaagactggggatCcaagaaattcatccgtagagatttt | 22 |

TABLE 2-continued

| Neoepitope ID | Polynucleotide sequence | SEQ ID NO: |
|---|---|---|
| M12 | tttgtgcaaggcaaagactggggaGtcaagaaattcatccgtagagatttt | 24 |
| M13 | tataggtttgtgcaaggcaaagactgTggattcaagaaattcatccgtaga | 26 |
| M14 | tataggtttgtgcaaggcaaagacGggggattcaagaaattcatccgtaga | 28 |
| M15 | tataggtttgtgcaaggcaaagactggggattcaagaaattcatccgtaga | 30 |
| M16 | tataggtttgtgcaaggcaaagacCggggattcaagaaattcatccgtaga | 32 |
| M17 | tataggtttgtgcaaggcaaagactCgggattcaagaaattcatccgtaga | 34 |
| M18 | tatcccgtgggctacgaggccacgcAcatctattggagcctccgcaccaac | 36 |
| M19 | atgttcgagaacggctgctacttgTgccgccagaagcgcttcaagtgcgag | 38 |
| M20 | ggcaagggctcctactggacgctgcaGccggactccggcaacatgttcgag | 40 |
| M21 | ggcaagggctcctactggacgctgcTcccggactccggcaacatgttcgag | 42 |
| M22 | ggcaagggctcctactggacgctgAacccggactccggcaacatgttcgag | 44 |
| M23 | ggcaagggctcctactggacgctgTacccggactccggcaacatgttcgag | 46 |
| M24 | tgctacttgcgccgccagaagcgctGcaagtgcgagaagcagccgggggcc | 48 |
| M25 | tgctacttgcgccgccagaagcgctCcaagtgcgagaagcagccgggggcc | 50 |
| M26 | atccgccactcgctgtccttcaatgGctgcttcgtcaaggtggcacgctcc | 52 |
| M27 | atccgccactcgctgtccttcaatAactgcttcgtcaaggtggcacgctcc | 54 |
| M28 | cagcagcgctggcagaactccatcTgccactcgctgtccttcaatgactgc | 56 |
| M29 | cagcagcgctggcagaactccatcAgccactcgctgtccttcaatgactgc | 58 |
| M30 | acgctgcacccggactccggcaacaAgttcgagaacggctgctacttgcgc | 60 |
| M31 | acgctgcacccggactccggcaacaGgttcgagaacggctgctacttgcgc | 62 |
| M32 | tgtcacaaaaagaatttcctgcatTgggatattaagtgttctaacattttg | 64 |
| M33 | attcactgtaaagctggaaagggacAaactggtgtaatgatatgtgcatat | 66 |
| M34 | tggctaagtgaagatgacaatcatTttgcagcaattcactgtaaagctgga | 68 |
| M35 | ggacttggtgatagacatgtacagaGtatcttgataaatgagcagtcagca | 70 |
| M36 | ggacttggtgatagacatgtacagaaAatcttgataaatgagcagtcagca | 72 |
| M37 | aacataaatattggcccaggtgactCtgaatggtagttgacctgaaggt | 74 |
| M38 | aacataaatattggcccaggtgactAtgaatggtttgttgttcctgaaggt | 76 |
| M39 | ttcatgaaacaaatgaatgatgcacGtcatggtggctggacaacaaaaatg | 78 |
| M40 | cgagatcctctctctgaaatcactAagcaggagaaagattttctatggagt | 80 |
| M41 | cgagatcctctctctgaaatcactgGgcaggagaaagattttctatggagt | 82 |
| M42 | cgagatcctctctctgaaatcactgCgcaggagaaagattttctatggagt | 84 |
| M43 | tctggaatccattctggtgccactGccacagctccttctctgagtggtaaa | 86 |
| M44 | cactggcagcaacagtcttacctggCctctggaatccattctggtgccact | 88 |
| M45 | cactggcagcaacagtcttacctgCactctggaatccattctggtgccact | 90 |
| M46 | cactggcagcaacagtcttacctggTctctggaatccattctggtgccact | 92 |
| M47 | cactggcagcaacagtcttacctgTactctggaatccattctggtgccact | 94 |
| M48 | tcttacctggactctggaatccatGctggtgccactaccacagctccttct | 96 |
| M49 | tcttacctggactctggaatccattGtggtgccactaccacagctccttct | 98 |

TABLE 2-continued

| Neoepitope ID | Polynucleotide sequence | SEQ ID NO: |
|---|---|---|
| M50 | tcttacctggactctggaatccattTtggtgccactaccacagctccttct | 100 |
| M51 | tcttacctggactctggaatccattAtggtgccactaccacagctccttct | 102 |
| M52 | tctggtgccactaccacagctccttGtctgagtggtaaaggcaatcctgag | 104 |
| M53 | tctggtgccactaccacagctccaTtctgagtggtaaaggcaatcctgag | 106 |
| M54 | tctggtgccactaccacagctcctCctctgagtggtaaaggcaatcctgag | 108 |
| M55 | tacgtgcccagtgaggactactacaAgccctcaccgtatgatgacctcacc | 110 |
| M56 | atccggaagaggctaaagctctgcActgacttcaaacgcacagggatggat | 112 |
| M57 | gtggatggagccgtgtttgctgttTtcaaggctgtgtttgtacttggggat | 114 |
| M58 | atcgtggatggagccgtgtagctgGtctcaaggctgtgtagtacttggg | 116 |
| M59 | atcgtggatggagccgtgtttgctCttctcaaggctgtgtttgtacttggg | 118 |
| M60 | acacacactgccaatgagcggcggTggcgtggtgaaatgagggatctcttt | 120 |
| M61 | gggaggttcagcaaggtgtctagtcGagctcccatggagggtggggaagaa | 122 |
| M62 | ggaaagacagaagaccttggagcaGgtacaagttatttagtcgtgtgcca | 124 |
| M63 | atgaaccaccaCcagcagcagcagcagcagaaagcg | 126 |
| M64 | catggtcttgtggatgagcagcagGaagttcggaccatcagtgctaggcc | 128 |
| M65 | gcatgtcgtcatggagacaggtgctTtcggagcacaataaaccgacgta | 130 |
| M66 | agttgtactacaccgcaatgcaaatGcctgcttgcaaaatgttgtgagat | 132 |
| M67 | tccatattatctaaacaggttcaaCataaaccaaaaactggtcgaagttta | 134 |
| M68 | caaagaattggatctggatcatttgCaacagtctacaagggaaagtggcat | 136 |
| M69 | ggtgattaggtctagctacagtgGaatctcgatggagtgggtcccatcag | 138 |
| M70 | caagccaaccttcgacatctctgcTgcatctgtgggaattcttttagagct | 140 |
| M71 | caagccaaccttcgacatctctgccAcatctgtgggaattcttttagagct | 142 |
| M72 | gatcgctgcctcaagaaggtgtccAagggcgtggagcagtttgaagatatt | 144 |
| M73 | atcaagacatgggtagcgtccaacAagatcaaggacaagaggcagcttata | 146 |
| M74 | caaaaatttgatgaggcgctcaggAaaagctggactactaaagtgaactgg | 148 |
| M75 | tgggtaaaacctatcatcataggtTgtcatgcttatggggatcaatacaga | 150 |
| M76 | tgggtaaaacctatcatcataggtGgtcatgcttatggggatcaatacaga | 152 |
| M77 | tgggtaaaacctatcatcataggtcAtcatgcttatggggatcaatacaga | 154 |
| M78 | tataagctggtggtggtgggcgccgAcggtgtgggcaagagtgcgctgacc | 156 |
| M79 | tataagctggtggtggtgggcgccCgcggtgtgggcaagagtgcgctgacc | 158 |
| M80 | ttggacatcctggataccgccggAAaggaggagtacagcgccatgcgggac | 160 |
| M81 | ttggacatcctggataccgccggccTggaggagtacagcgccatgcgggac | 162 |
| M82 | ttggacatcctggataccgccggccGggaggagtacagcgccatgcgggac | 164 |
| M83 | gagggaggctgcacaaacgagggAagtacatcaagacctggcggccacgc | 166 |
| M84 | attgcgagagagctgcatcagttcGcttagacctgctaatcaagtcacac | 168 |
| M85 | attgcgagagagctgcatcagttcGGttagacctgctaatcaagtcacac | 170 |
| M86 | cagcccgactcctagcagccttgcActctagcctcaatgaactgggagag | 172 |

TABLE 2-continued

| Neoepitope ID | Polynucleotide sequence | SEQ ID NO: |
|---|---|---|
| M87 | cagatggctgtcattcagtactcctTgatggggctcatggtgtagccatg | 174 |
| M88 | cagatggctgtcattcagtactcctTTatggggctcatggtgtagccatg | 176 |

Table 3 shows the gene origin, the specific frameshift mutation (FR), the amino acid sequences of the identified neoantigens that arose from frameshift events and frequency of the mutation in patients. The wild-type sequence is bolded in Table 3, followed by the novel sequence due to frameshift. Table 4 shows their corresponding polynucleotide sequences. The mutant sequences are capitalized in Table 4. Patient frequency (%) in Table 3 was obtained from Armenia et al., *Nat Genet* 50(5): 645-651, 2018.

TABLE 3

| Neoepitope ID | Gene | Frameshift | Patient Frequency (%) | Amino acid sequence | SEQ ID NO: |
|---|---|---|---|---|---|
| FR1 | ZFHX3 | E7635fs*61 | 0.2962 | **QNLQNGGG**SRSSATLPGR RRRRWLRRRRQPISVAPA GPPRRPNQKPNPPGGARC VIMRPTWPGTSAFT | 177 |
| FR2 | ZFHX3 | E763Gfs*26 | 0.0987 | **QNLQNGGG**GAGLQPHCR GGGGGGGCGGGGSQYQ | 179 |
| FR3 | APC | T1556Nfs*3 | 0.3949 | **NQEKEAEK**NY | 181 |
| FR4 | SPEN | A2105Lfs*33 | 0.1974 | **DAAVSPRG**LQHRQGRGN LGWWQSPLRKVRVPKRR MVYHPS | 183 |
| FR5 | BRCA2 | T3085Nfs*26 | 0.1974 | **FVVSVVKK**NRTCPFRLFV RRMLQFTGNKVLDRP | 185 |
| FR6 | BRCA2 | K2674Rfs*2 | 0.1974 | **RSRRSAIK**R | 187 |
| FR7 | ARID4A | S1067Rfs*16 | 0.2962 | **SIIVQERE**RAERRVRRGQ VMEIVD | 189 |
| FR8 | SMARCAD1 | N770Kfs*28 | 0.1974 | **NNLVTEKK**HRNVQCHDA VEENGQSSFITSPILHS | 191 |
| FR9 | RNF43 | G659Vfs*41 | 0.3949 | **HPQRKHRG**VPPSPPLALG PRMQLCTQLARFFPITPPV WHILGPQRHTP | 193 |
| FR10 | AXIN2 | G665Afs*24 | 0.1974 | **ASRHHLWG**ATAGTPAPPP VPTCSPRTLRCLP | 195 |
| FR11 | ERF | L525Sfs*6 | 0.2962 | **GPGEAGGP**SPQGG | 197 |
| FR12 | ERF | G299Efs*12 | 0.2962 | **GGGPSGSG**EAPTSPSALRT | 199 |
| FR13 | CHD3 | R599Vfs*16 | 0.3949 | **GNPDVPPP**VLFKADQSES SLSSG | 201 |
| FR14 | KMT2C | S143Vfs*3 | 0.2962 | **AFCYCGEK**VP | 203 |
| FR15 | FOXA1 | M253_N256del | 0.0987 | **TLHPDSGN**GCYLRRQK | 205 |
| FR16 | FOXA1 | F254_N256delinsY | 0.2962 | **LHPDSGNM**YGCYLRRQ | 207 |
| FR17 | FOXA1 | F254_G257delinsC | 0.0987 | **LHPDSGNM**CCYLRRQKR | 209 |

TABLE 4

| Neo-antigen ID | Polynucleotide sequence | SEQ ID NO: |
|---|---|---|
| FR1 | Cagaacctgcagaatggagggggggagcaggtc ttcagccacactgccggggcggcggcggcggc ggtggctgcggcggcggcggcagccaatatca | 178 |

TABLE 4-continued

| Neo-antigen ID | Polynucleotide sequence | SEQ ID NO: |
|---|---|---|
| | gtagctcctgcggggcccccctcgccgaccaaaccaaaaaccaaacccacctggcggtgcgaggtgtgtgattatgagaccaacgtggccaggaacctccgcattcaca | |
| FR2 | cagaacctgcagaatggagggggGgagcaggtcttcagccacactgccggggcggcggcggcggcggtggctgcggcggcggcggcagccaatatcagtag | 180 |
| FR3 | aaccaagagaaagaggcagAaaaaaactattga | 182 |
| FR4 | gatgctgctgtcagtcccagggggctgcagcacaggcaggggagagggaatctggggtggtggcagtctcccctgagaaaagtgagagtccccaaaaggaggatggtttatcatcccagttga | 184 |
| FR5 | tttgtcgtttctgttgtgaAaaaaaacaggacttgcccctttcgtctatttgtcagacgaatgttacaatttactggcaataaagttttggatagaccttaa | 186 |
| FR6 | agaagcagaagatcggctataaaaagataatg | 188 |
| FR7 | agtataattgtacaAGagagagagagagcagagagaagggtcagaagaggccaagtgatggaaatagtggattaa | 190 |
| FR8 | aataacttggtcacagAaaaaaaacacagaaatgtgcaatgtcatgatgcagttgaggaaaatggccaatcatcctttattacatcgccaatattacacagctgaaa | 192 |
| FR9 | cacccacagaggaaaaggcgggggtccctccgagcccacccctggctctcggccccaggatgcaactgtgcacccagcttgccagatttttccccattacacccccagtgtggcatatccttggtccccagaggcacaccccttgatc | 194 |
| FR10 | gccagccggcaccatctgtgggggcaacagcgggcacccccgcaccacccccgtgcccacctgttcacccaggaccctgcgatgcctcccctgacc | 196 |
| FR11 | gggcctggggaggctgggggcccctcaccccaaggcgggtgagc | 198 |
| FR12 | ggcgggggcccagcggctcaggggaggctcccacttctccttcagccctgaggacatgaaa | 200 |
| FR13 | ggaaatccagatgtcccaccccccgtcctcttcaaggcagatcagagcgagagttctttgtcaagtgggtag | 202 |
| FR14 | gctttttgttactgtggggaaaaagttccttagga | 204 |
| FR15 | acgctgcacccggactccggcaacggctgctacttgcgccgccagaagcg | 206 |
| FR16 | acgctgcacccggactccggcaacatgtacggctgctacttgcgccgccagaa | 208 |
| FR17 | ctgcacccggactccggcaacatgtgctgctacttgcgccgccagaagcgc | 210 |

Table 5 shows the gene origin and amino acid sequences of the identified neoantigens that arose from gene fusion (FUS) events. Table 6 shows their corresponding polynucleotide sequences. Table 7 shows the prevalence of the FUS neoantigens in analyzed databases.

TABLE 5

| Neo-antigen ID | Fusion Gene | Amino acid sequence | SEQ ID NO: |
|---|---|---|---|
| FUS1 | SLC45A3->ELK4 | CGASACDVSLIAMDSA | 211 |
| FUS2 | ARHGEF38->ARHGEF38-IT1 | TEYNQKLQVNQFSESK | 213 |
| FUS3 | MSMB->NCOA4 | TEISCCTLSSEENEYLPRPEWQLQ | 215 |
| FUS4 | LIPE->CNFN | GLVSFGEHFCLPCALC | 217 |
| FUS5 | TMPRSS2->ERG | NSKMALNSEALSVVSE | 219 |
| FUS6 | TMPRSS2->ERG | CEERGAAGSLISCE | 221 |
| FUS7 | NME4->DECR2 | LWFQSSELSPTGAPWPSRRPTWRGTTVSPRTATSSARTCCGTKWPSSQEAALGLGSGLLRFSCGTAAIR | 223 |
| FUS8 | INCA1->CAMTA2 | WGMELAASRRFSWDHHSAGGPPRVPSVRSGAAQVQPKDPLPLRTLAGCLARTAHLRPGAESLPQPQLHCT | 225 |
| FUS9 | AP5S1->MAVS | KEQILAVASLVSSQSIHPSWGQSPLSRI | 227 |
| FUS10 | DIP2A->DIP2A-IT1 | LELELSEGVCFRLR | 229 |
| FUS11 | MBTPS2->YY2 | QQLRIFCAAMASNEDFS | 231 |
| FUS15 | D2HGDH->GAL3ST2 | HVVGYGHLDTSGSSSSSSWP | 345 |
| FUS18 | OPN3->CHML | DGFSGSL-FAVVTRRCYFLKWRTIFPQSLMWL | 233 |
| FUS19 | GTF2F1->PSPN | KMHFSLKEHPPPPCPP | 235 |
| FUS23 | NUDT14->JAG2 | DLRRVATYCA-PLPSSWRPGTGTTIPPRMRSC | 237 |
| FUS24 | DMPK->SIX5 | LQERMELLACGAER-GAGGWGGGGGGGGGDRRGGGGSAPALADFAGGRG | 239 |

TABLE 6

| Neoantigen ID | Polynucleotide sequence | SEQ ID NO: |
|---|---|---|
| FUS1 | TGCGGGGCCTCTGCCTGTGATGTCTCCCTCATTGCTAT GGACAGTGCT | 212 |
| FUS2 | ACCGAATACAACCAGAAATTACAAGTGAATCAATTTA GTGAATCCAAA | 214 |
| FUS3 | ACAGAAATTTCATGTTGCACCCTGAGCAGTGAGGAGA ATGAATACCTTCCAAGACCAGAGTGGCAGCTCCAG | 216 |
| FUS4 | GGGCTGGTGTCCTTCGGGGAGCACTTTTGTCTGCCCTG CGCCCTCTGCCA | 218 |
| FUS5 | AACAGCAAGATGGCTTTGAACTCAGAAGCCTTATCAGT TGTGAGTGAG | 220 |
| FUS6 | TGTGAGGAGCGCGGCGCGGCAGGAAGCCTTATCAGTT GTGAG | 222 |
| FUS7 | CTGTGGTTCCAGAGCAGTGAGCTGTCCCCGACGGGAG CGCCATGGCCCAGCCGCCGCCCGACGTGGAGGGGGAC GACTGTCTCCCCGCGTACCGCCACCTCTTCTGCCCGGA CCTGCTGCGGGACAAAGTGGCCTTCATCACAGGAGGC GGCTCTGGGATTGGGTTCCGGATTGCTGAGATTTTCAT GCGGCACGGCTGCCATACGG | 224 |
| FUS8 | TGGGGGATGGAGTTGGCAGCGTCTCGGAGGTTCTCCTG GGACCACCACTCCGCCGGGGGGCCGCCCAGAGTGCCA AGCGTCCGATCCGGCGCCGCCCAAGTGCAGCCCAAGG ACCCGCTCCCGCTCCGCACCCTGGCAGGCTGCCTAGCC AGGACTGCGCACCTGCGCCCTGGGGCGGAGTCCTTACC CCAACCCCAGCTTCACTGCACA | 226 |
| FUS9 | AAGGAACAGATTTTAGCTGTGGCCAGTCTCGTTTCCTC TCAGTCCATCCACCCTTCATGGGGCCAGAGCCCTCTCT CCAGAATC | 228 |
| FUS10 | CTGGAGCTGGAGCTGTCGGAAGGAGTCTGCTTCAGATT AAGA | 230 |
| FUS11 | CAGCAGCTAAGGATATTTTGTGCAGCCATGGCCTCCAA CGAAGATTTCTCCA | 232 |
| FUS15 | CACGTGGTGGGCTATGGCCACCTTGATACTTCCGGGTC ATCCTCCTCCTCCTCCTGGCCC | 346 |
| FUS18 | GACGGGTTTAGCGGCAGCCTCTTCGCAGTTGTCACCAG ACGCTGTTACTTCCTAAAATGGCGGACAATCTTCCCAC AGAGTTTGATGTGGTTA | 234 |
| FUS19 | AAAATGCACTTCTCCCTCAAGGAGCACCCACCGCCCCC TTGCCCGCCT | 236 |
| FUS23 | GATCTGCGCCGGGTCGCCACATACTGCGCTCCTTTACC CTCATCGTGGAGGCCTGGGACTGGGACAACGATACCA CCCCGAATGAGGAGCTGC | 238 |
| FUS24 | TTGCAGGAGCGGATGGAGTTGCTTGCCTGCGGAGCCG AGCGCGGGGCCGGCGGCTGGGGGGGAGGCGGTGGCG GCGGCGGCGGCGACCGAAGAGGAGGAGGAGGAAGCG CGCCAGCTCTTGCAGACTTTGCAGGCGGCCGAGGG | 240 |

TABLE 7

| Neoantigen ID | TCGA (%) | SU2C (%) |
|---|---|---|
| FUS1 | 30.51 | 23.26 |
| FUS2 | 63.58 | 46.51 |
| FUS3 | 35.04 | 23.26 |
| FUS4 | 12.20 | 11.63 |
| FUS5 | 12.40 | 18.60 |
| FUS6 | 21.46 | 32.56 |
| FUS7 | 3.35 | 16.28 |
| FUS8 | 1.18 | 32.56 |
| FUS9 | N.O. | 18.60 |
| FUS10 | N.O. | 13.95 |
| FUS11 | 1.57 | 13.95 |
| FUS15 | 0.39 | 9.30 |
| FUS18 | 0.39 | 9.30 |
| FUS19 | 8.86 | 30.23 |
| FUS23 | N.O. | 9.30 |
| FUS24 | N.O. | 9.30 |

N.O. not observed

Table 8 shows the gene origin and amino acid sequences of the identified neoantigens that arose from alternative splicing (AS) events. Table 9 shows their corresponding polynucleotide sequences. Table 10 shows the prevalence of the AS neoantigens in analyzed databases.

TABLE 8

| Neoepitope ID | Gene | Amino acid sequence | SEQ ID NO: |
|---|---|---|---|
| AS1 | ABCC4 | LTFLDFIQVTLRVMSGSQMENGSSYFFK PFSWGLGVGLSAWLCVMLT | 241 |
| AS2 | SLC30A4 | FMIGELVGELCCQLTFRLPFLESLCQAV VTQALRFNPSFQEVCIYQDTDLM | 243 |
| AS3 | DNAH8 | VAMMVPDRQVHYDFGL | 245 |
| AS4 | NCAPD3 | WCPLDLRLGSTGCLTCRHHQTSHE | 247 |
| AS5 | DHDH | VVGRRHETAPQPLLVPDRAGGEGGA | 249 |
| AS6 | ACSM1 | DYWAQKEKISIPRTHLC | 251 |
| AS7 | ACSM1 | DYWAQKEKGSSSFLRPSC | 253 |
| AS8 | CACNA1D | LVLGVLSGHSGSRL | 255 |
| AS9 | CACNA1D | PVPTATPGVRSVTSPQGLGLFLKFI | 257 |
| AS10 | CHRNA5 | KENDVREVCDVYLQMQIFFHFKFRSYF H | 259 |
| AS11, AS33 | CPNE7 | VPFRELKNQRTAQGAPGIHHAASPVAA NLCDPARHAQHTRIPCGAGQVRAGRGP EAGGGVLQPQRPAPEKPGCPCRRGQPRL HTVKMWRA | 261 |
| AS12 | EVPL | FARKMLEKVHRQHLQLSHNSQE | 263 |
| AS13 | GRIN3A | KRSFAVTERII | 265 |
| AS14 | IQCG | MFLRKEQQVGPHSFSML | 267 |
| AS15 | LRRC45 | VLRFLDLKVRYLHS | 269 |
| AS16 | LRRC45 | GNTTLQQLGEASQAPSGSLIPLRLPLLW EVRG | 271 |
| AS17 | MPHOSPH9 | GLNLNTDRPGGYSYSIWWKNNAKNR | 273 |
| AS18 | NWD1 | WKFEMSYTVGGPPPHVHARPRHWKTD R | 275 |
| AS19 | NWD1 | QWQHYHRSGEAAGTPLWRPTRN | 277 |
| AS20 | PFKFB4 | KVLNEIDAVVTVPPSLSTSQIPQGCCIIL | 279 |
| AS21 | RECQL4 | ANLKGTLQVRSGQAVSPR | 281 |
| AS22 | TONSL | LQAAASGQGKQGVPCPWGCCAYAESP RALISGDAPSQVEREVPGPCLNTHSLSHR SPQLPGLPHPKQPSV | 283 |
| AS23 | ZNF614 | KIQNKNCPD | 285 |
| AS32 | TONSL | GEVELSEGGEGQRHLAFPWACSGPGWR GVCCAAVEPA | 287 |
| AS63 | TDRD1 | IEMKKLLKS | 289 |
| AS34 | LRRC45 | KMRAIQAEGGHGQACCGGAWGWAPG DGGPQGMLTHTLPTLGFQSAWTWRRED ADRAWRTPKACASRRWSI | 291 |
| AS35 | AMACR | LLEPFRRGEPGPRGLLSGSSRGGEGPGR SIEAAPATPLPCCRKNPCRPQPSRFLPPRV LLVIILPKLDCPKLGF | 293 |

TABLE 8-continued

| Neoepitope ID | Gene | Amino acid sequence | SEQ ID NO: |
|---|---|---|---|
| AS36 | CCNF | **PSGRRTKR**LVTLRSGCAIQCWHPRAGP VPSALPHTERPPRLVRGAADPRTVTLGR SPAVMPRAPA | 295 |
| AS37 | RECQL4 | **CHLFLQPQ**VGTPPPHTASARAPSGPPHP HESCPAGRRPARAAQTCARRQHGLPGC EEAGTARVPSLHLHLHQAALGAGRGRG WGEACAQVPPSRG | 297 |
| AS38 | LRRC45 | **KELKLEQQ**VGGQGLRGVGQGVRGGFV TLTTHTPFPSQ**EAAERESK** | 299 |
| AS39 | CCNF | **GEISQEEV**PPSRHLGVSWGAGVWAGLT LGASAPPNSSFPSGAELQPVVCCIRSDTR QPRPPDFPQHRGDPRLPQLSLGAENQTV SYPAFWLRHTMLASSCRPSSLSASSHRE APKACQGSSRSQDSDPGTEPCSHASGPC VTSTVSSPGLLPQRLLPLALTGLPVEEDG FEHAGA | 301 |
| AS40 | LRRC45 | **DCMLSEEG**GQARRGGSLCSLAAHTIAS AARGRFLSRLSNFCAVVKASRGAPSCTW E | 303 |
| AS41 | RHPN1 | **EAFQRAAG**EGGPGRGGARRGARVLQSP FCRAGAGEWLGHQSLR | 305 |
| AS42 | SLC39A4 | **PEPRRLSP**GEPRGRPRKGWGIWGLCGA RVGPKAWR | 307 |
| AS43 | CPNE7 | **VPFRELKN**VSVLEGLRQGRLGGPCSCH CPRPSQARLTPVDVAGPFLCLGDPGLFPP VKSSI | 309 |
| AS44 | FASN | **FVSLTAIQ**MASSATPWGRWPVATPTAA CPRRRPSSLPTGGDSASKKPISRRAPWQP WACPGRSVNSAAPRAWCPPATTPRTQSP SRDLRPRCLSSWSS | 311 |
| AS45 | RBM47 | **PVAIKPGT**GPPNNSSIHGGSKRSENSYCR DLRGQLRAICCSSYSHDRHTTEERGSRG RHVWRIRRLHTSGLPCCCHSGPHPRRLP DILRLVTSTKTDHTNTTEGTLDYL | 313 |
| AS46 | SERINC5 | **KWNKNWTA**TLGALTIRGHKLLCHLPHL LSSVQQTCRSSSR | 315 |
| AS47 | AGRN | **FKKFDGPC**GERGGGRTARALWARGDS VLTPALDPQTPVRAPSLTRAAAAV | 317 |
| AS48 | SYT17 | **ENASLVFT**GSNSPIPACELSSHPAHGISP WIPSPGNEHFHGIKKQVKAIKVE | 319 |
| AS49 | PDF | **RLTQRLVQ**GWTPMENRWCGRRAGGQP ASSSTRWTTCRAACLLTKWTAGRSQTSI G | 321 |
| AS50 | LRIF1 | **ENSGNASR**WLHVPSSSDDWLGWKKSSA ITSNS | 323 |
| AS51 | CPNE7 | **GMECTLGQ**VGAPSPRREEDGWRGGHS RFKADVPAPQGPCWGGQPGSAPSSAPPE QSLLD | 325 |
| AS52 | ILDR1 | **KGSVERRS**VSLGHPAEGWAWAERSLQP GMTTANTGCLSFHHRGCLLPVLPKLHCG LGGLPLVRAKEIKRVQRAGESSLPVKGL LTVASAVIAVLWGRPSEVTGENEAQHD | 327 |
| AS53 | PEX10 | **FGLTTLAG**RSSHGTSGLRAATHTKSGD GGQGAARQCEKLLELARATRPWGRSTS ASSRWTHRGYMCPPRCAVACW | 329 |
| AS54 | ABCC4 | **IIDSDKIM**AVCMGCLLTRHVQCQAMEM QQ | 331 |

TABLE 8-continued

| Neoepitope ID | Gene | Amino acid sequence | SEQ ID NO: |
|---|---|---|---|
| AS55 | SPOCK1 | **DGHSYTSK**VNCLLLQDGFHGCVSITGA AGRRNLSIFLFL**MLCKLEFHAC** | 333 |
| AS56 | TM9SF3 | **LLNAEDYR**CAIHSKEIYLLSPSPHQAMD KFSLCCINCNLCLHVFLLLLFFQNKDVW LISNIILLWIYGGI | 335 |
| AS57 | KLK3 | **TGGKSTCS**APGPQSLPSTPFSTYPQ**WVI LITEL** | 337 |
| AS58 | CREB3L1 | **VETLENAN**SFSSGIQPLLCSLIGLENPT | 339 |
| AS59 | ACSL3 | **AGAGTISE**GSVLHGQRLECDARRFFGCG TTILAEWEHH | 341 |
| AS55.1 | SPOCK1 | **DGHSYTSK**VNCLLLQDGFHGCVSITGA AGRRNLSIFLFLMLCKLEFHA | 385 |

TABLE 9

| Neoepitope ID | Polynucleotide sequence | SEQ ID NO: |
|---|---|---|
| AS1 | CTGACGTTTTTAGATTTCATCCAGGTAACGTTGAGA GTAATGTCAGGATCTCAAATGGAAAACGGAAGTTC CTATTTTTTCAAGCCCTTTTCATGGGGTCTGGGGGTG GGACTCTCGGCCTGGCTGTGTGTAATGTTAACT | 242 |
| AS2 | TTCATGATTGGAGAACTTGTAGGTGAGTTGTGTTGC CAACTCACTTTCCGTTTACCTTTCCTCGAGAGTCTTT GTCAAGCTGTAGTTACACAGGCTTTGAGGTTTAACC CATCTTTTCAGGAAGTTTGTATTTATCAAGACACTG ATCTCATG | 244 |
| AS3 | GTTGCTATGATGGTTCCTGATAGACAGGTTCATTAT GACTTTGGATTG | 246 |
| AS4 | TGGTGTCCGCTGGATCTTAGACTCGGTTCCACTGGA TGTCTCACATGCAGACATCATCAAACGTCACATGAG | 248 |
| AS5 | GTCGTGGGAAGGCGTCATGAAACAGCTCCTCAACC CCTGCTGGTGCCCGACCGAGCTGGTGGTGAAGGGG GAGCA | 250 |
| AS6 | GACTACTGGGCTCAAAAGGAGAAGATCAGCATCCC CAGAACACACCTGTGT | 252 |
| AS7 | GACTACTGGGCTCAAAAGGAGAAGGGATCATCTTC ATTCCTGCGACCATCCTGT | 254 |
| AS8 | CTTGTACTTGGTGTATTGAGCGGGCACAGTGGCTCA CGCCTA | 256 |
| AS9 | CCTGTCCCAACTGCTACACCTGGGGTAAGATCAGTG ACTAGTCCCCAGGGGCTGGGCCTTTTCCTTAAGTTT ATT | 258 |
| AS10 | AAGGAAAATGATGTCCGTGAGGTCTGTGATGTGTAT TTACAAATGCAGATCTTCTTCCATTTTAAGTTCAGA AGTTACTTTCAT | 260 |
| AS11, AS33 | GTGCCCTTCCGGGAGCTCAAGAACCAGAGAACAGC ACAAGGGGCTCCTGGGATCCACCACGCGGCTTCCCC CGTTGCTGCCAACCTCTGCGACCCGGCGAGACACGC ACAGCACACACGCATCCCCTGCGGCGCTGGCCAAG TGCGTGCTGGCCGAGGTCCCGAAGCAGGTGGTGGA GTACTACAGCCACAGAGGCCTGCCCCCGAGAAGCC TGGGTGTCCCTGCCGGAGAGGCCAGCCCAGGCTGC ACACCGTGAAGATGTGGAGGGCG | 262 |
| AS12 | TTTGCTAGAAAAATGCTGGAGAAGGTACACAGACA ACACCTACAGCTTTCCCACAATAGCCAGGAA | 264 |
| AS13 | AAGAGAAGTTTTGCTGTCACGGAGAGGATCATC | 266 |

TABLE 9-continued

| Neoepitope ID | Polynucleotide sequence | SEQ ID NO: |
|---|---|---|
| AS14 | ATGTTCCTTAGAAAGGAGCAGCAGGTGGGTCCCCA CAGCTTTTCTATGCTT | 268 |
| AS15 | GTGCTGCGCTTTCTGGACTTAAAGGTGAGATACCTG CACTCT | 270 |
| AS16 | GGCAACACCACCCTCCAGCAGCTGGGTGAGGCCTC CCAGGCGCCCTCAGGCTCCCTCATCCCTCTGAGGCT GCCTCTGCTCTGGGAAGTGAGGGGC | 272 |
| AS17 | GGACTGAACTTAAATACTGATAGACCAGGTGGTTAC AGCTATTCAATTTGGTGGAAAAACAATGCCAAGAA CAGA | 274 |
| AS18 | TGGAAATTCGAGATGAGCTACACGGTGGGTGGCCC GCCTCCCCATGTTCATGCTAGACCCAGGCATTGGAA AACTGATAGA | 276 |
| AS19 | CAGTGGCAGCACTACCACCGGTCAGGTGAGGCCGC AGGGACTCCCCTCTGGAGACCCCACAAGAAAC | 278 |
| AS20 | AAGGTCCTCAACGAGATCGATGCGGTAGTTACCGTC CCTCCCTCCCTGTCTACCTCCCAGATACCGCAGGGC TGCTGCATCATATTG | 280 |
| AS21 | GCCAATCTGAAAGGCACCCTGCAGGTGAGGAGTGG GCAGGCAGTGAGTCCACGC | 282 |
| AS22 | CTCCAGGCGGCTGCCTCGGGCCAAGGCAAGCAGGG CGTCCCTTGTCCCTGGGGTTGCTGTGCCTACGCTGA GAGTCCCCGGGCCCTGATTTCGGGAGATGCTCCATC ACAGGTGGAGCGGGAGGTGCCGGGCCCCTGCCTCA ACACGCATTCTCTCTCCCACAGATCCCCACAGCTCC CAGGCCTTCCACACCCCAAGCAGCCTTCTGTT | 284 |
| AS23 | AAAATTCAGAATAAAAATTGTCCAGAC | 286 |
| AS32 | GGCGAGGTGGAGCTCTCAGAGGGCGGTGAGGGCCA GCGGCACCTTGCATTTCCCTGGGCCTGCTCTGGGCC GGGCTGGAGAGGGGTGTGCTGTGCTGCTGTGGAGC CTGCT | 288 |
| AS63 | ATTGAAATGAAAAAACTGTTAAAAAGT | 290 |
| AS34 | AAGATGCGGGCCATCCAGGCCGAGGGTGGGCACGG GCAGGCCTGCTGTGGAGGGGCCTGGGGATGGGCAC CGGGGGACGGGGGCCCCCAGGGGATGCTCACGCAT ACTCTGCCCACCCTGGGCTTCCAGAGCGCCTGGACA TGGAGAAGAGAAGATGCAGACAGAGCCTGGAGGAC TCCGAAAGCCTGCGCATCAAGGAGGTGGAGCATA | 292 |
| AS35 | CTGCTGGAGCCCTTCCGCCGCGGTGAGCCCGGGCCC CGCGGGCTGCTCTCGGGAAGTTCCCGCGGAGGGGA GGGGCCTGGCCGTTCGATCGAGGCTGCACCCGCCAC ACCTTTGCCCTGTTGCCGCAAGAACCCCTTGTCGGCC CCAGCCTTCCAGATTTTTGCCTCCTAGGGTATTGTTA GTGATCATTCTTCCCAAACTGGATTGTCCAAAACTT GGGTTC | 294 |
| AS36 | CCCTCGGGGCGGAGAACCAAACGGTTAGTTACCCT GCGTTCTGGCTGCGCCATACAATGCTGGCATCCTCG TGCCGGCCCAGTTCCCTCAGCGCTTCCTCACACAGA GAGGCCCCCAAGGCTTGTCAGGGGAGCAGCAGATC CCAGGACAGTGACCCTGGGACGGAGCCCTGCAGTC ATGCCTCGGGCCCCTGCG | 296 |
| AS37 | TGCCACCTCTTCCTGCAGCCCCAGGTTGGCACCCCC CCCCCCCACACTGCCAGTGCTCGAGCCCCCAGTGGT CCACCCCACCCTCATGAAAGTTGCCCTGCAGGGCGA AGACCTGCGAGAGCTGCGCAGACATGTGCACGCCG ACAGCACGGACTTCCTGGCTGTGAAGAGGCTGGTA CAGCGCGTGTTCCCAGCCTGCACCTGCACCTGCACC AGGCCGCCCTCGGAGCAGGAAGGGGCCGTGGGTGG GGAGAGGCCTGTGCCCAAGTACCCCCCTCAAGAGG C | 298 |

TABLE 9-continued

| Neoepitope ID | Polynucleotide sequence | SEQ ID NO: |
|---|---|---|
| AS38 | AAGGAGCTCAAGCTGGAGCAGCAGGTGGGTGGGCA GGGCTTGAGAGGGGTGGGCCAAGGGGTGCGTGGCG GCTTCGTGACCCTCACTACCCATACCCCGTTCCCCTC CCAGGAAGCTGCAGAGCGGGAGTCTAAA | 300 |
| AS39 | GGAGAAATCAGCCAGGAAGAGGTGCCTCCCTCCCG CCACCTGGGCGTCTCATGGGGTGCTGGGGTGTGGGC GGGCCTCACCCTCGGGGCCTCTGCACCCCCTAACTC TAGCTTCCCCTCAGGTGCTGAGCTACAGCCAGTTGT GTGCTGCATTAGGAGTGACACAAGACAGCCCCGAC CCCCCGACTTTCCTCAGCACAGGGGAGATCCACGCC TTCCTCAGCTCTCCCTCGGGGCGGAGAACCAAACGG TTAGTTACCCTGCGTTCTGGCTGCGCCATACAATGC TGGCATCCTCGTGCCGGCCCAGTTCCCTCAGCGCTT CCTCACACAGAGAGGCCCCCAAGGCTTGTCAGGGG AGCAGCAGATCCCAGGACAGTGACCCTGGGACGGA GCCCTGCAGTCATGCCTCGGGCCCCTGCGTAACCTC CACTGTCTCCAGCCCAGGTCTCCTTCCTCAGAGGCT ATTGCCTCTCGCTCTGACTGGGCTCCCTGTGGAGGA AGATGGTTTCGAGCACGCGGGAGCC | 302 |
| AS40 | GACTGCATGCTCAGCGAGGAAGGTGGGCAGGCGCG GCGGGGTGGATCCCTCTGCTCCTTAGCTGCCCACAC CATTGCCTCGGCAGCCCGAGGTCGCTTCCTCTCCAG GCTCTCCAATTTCTGTGCCGTAGTTAAAGCGAGCAG GGGCGCCCCTTCCTGCACCTGGGAG | 304 |
| AS41 | GAGGCCTTCCAGAGGGCCGCTGGTGAGGGCGGCCC GGGCCGCGGTGGGGCACGGCGCGGTGCCAGGGTGT TGCAGAGCCCCTTTTGCAGGGCAGGAGCTGGGGAG TGGTTAGGACATCAGTCCCTCAGG | 306 |
| AS42 | CCTGAGCCCAGGAGACTGAGCCCAGGTGAGCCCAG GGGGCGACCCCGGAAGGGCTGGGGGATCTGGGGTT TGTGTGGAGCGCGGGTGGGGCCCAAGGCTTGGCGG | 308 |
| AS43 | GTGCCCTTCCGGGAGCTCAAGAACGTGAGTGTCCTG GAGGGGCTCCGTCAAGGCCGGCTTGGGGGTCCCTGT TCATGTCACTGCCCAAGACCTTCCCAGGCCAGGCTC ACGCCAGTGGATGTGGCAGGTCCCTTCTTGTGTCTG GGGGATCCTGGGCTGTTCCCCCCAGTCAAGAGCAGT ATC | 310 |
| AS44 | TTTGTGAGCCTGACTGCCATCCAGATGGCATCGTCG GCCACTCCCTGGGGGAGGTGGCCTGTGGCTACGCCG ACGGCTGCCTGTCCCAGGAGGAGGCCGTCCTCGCTG CCTACTGGAGGGGACAGTGCATCAAAGAAGCCCAT CTCCCGCCGGGCGCCATGGCAGCCGTGGGCTTGTCC TGGGAGGAGTGTAAACAGCGCTGCCCCCCGGGCGT GGTGCCCGCCTGCCACAACTCCAAGGACACAGTCA CCATCTCGGGACCTCAGGCCCCGGTGTTTGAGTTCG TGGAGCAGC | 312 |
| AS45 | CCAGTTGCCATTAAACCTGGTACAGGGCCGCCCAAT AACTCCAGTATACACGGTGGCTCCAAACGTTCAGAG AATTCCTACTGCCGGGATCTACGGGGCCAGTTACGT GCCATTTGCTGCTCCAGCTACAGCCACGATCGCCAC ACTACAGAAGAACGCGGCAGCCGCGGCCGCCATGT ATGGAGGATACGCAGGCTACATACCTCAGGCCTTCC CTGCTGCTGCCATTCAGGTCCCCATCCCCGACGTCT ACCAGACATACTGAGGCTGGTGACCAGCACGAAGA CAGACCACACAAACACCACTGAAGGAACGCTTGAC TATTTA | 314 |
| AS46 | AAGTGGAACAAGAACTGGACAGCCACACTCGGGGC TCTTACAATCAGGGGTCATAAGCTGCTATGTCACCT ACCTCACCTTCTCAGCTCTGTCCAGCAAACCTGCAG AAGTAGTTCTAGA | 316 |
| AS47 | TTCAAGAAGTTCGACGGCCCTTGTGGTGAGCGCGGC GGCGGGCGCACGGCTCGAGCTCTGTGGGCGCGCGG CGACAGCGTCCTGACTCCTGCCCTCGACCCCCAGAC CCCTGTCAGGGCGCCCTCCCTGACCCGAGCCGCAGC TGCCGTG | 318 |
| AS48 | GAAAATGCCAGCCTAGTGTTTACAGGATCCAACAG CCCCATACCAGCCTGCGAACTGAGTAGTCACCCAGC | 320 |

TABLE 9-continued

| Neoepitope ID | Polynucleotide sequence | SEQ ID NO: |
|---|---|---|
| | TCATGGTATCAGTCCTTGGATACCCTCACCTGGAAA TGAACATTTCCATGGCATAAAGAAGCAAGTAAAGG CAATAAAAGTAGAA | |
| AS49 | CGGCTGACGCAACGGCTGGTCCAGGGCTGGACCCC AATGGAGAACAGGTGGTGTGGCAGGCGAGCGGGTG GGCAGCCCGCATCATCCAGCACGAGATGGACCACC TGCAGGGCTGCCTGTTTATTGACAAAATGGACAGCA GGACGTTCACAAACGTCTATTGGA | 322 |
| AS50 | GAAAATTCAGGCAACGCCTCGCGTTGGCTGCATGTA CCAAGTAGTTCAGACGATTGGCTCGGATGGAAAAA ATCTTCTGCAATTACTTCCAATTCC | 324 |
| AS51 | GGCATGGAGTGCACCCTGGGGCAGGTGGGTGCCCC GTCCCCTCGGAGGGAGGAGGACGGTTGGCGTGGGG GCCACAGCCGATTCAAGGCTGATGTACCAGCACCG CAGGGACCCTGCTGGGGTGGCCAACCTGGCTCTGCC CCCTCCTCAGCTCCTCCTGAACAGTCATTATTAGAT | 326 |
| AS52 | AAAGGGAGTGTGGAGAGGCGCTCGGTGAGCCTGGG GCATCCTGCTGAGGGTTGGGCATGGGCAGAGAGGA GCCTCCAGCCAGGCATGACCACAGCCAACACAGGC TGCCTCTCATTCCACCACAGAGGGTGCCTCCTCCCT GTTTTGCCCAAATTACACTGTGGGCTAGGTGGACTA CCTCTTGTCAGAGCTAAAGAAATCAAGCGAGTGCA GAGGGCAGGGGAGAGTTCGCTGCCTGTGAAGGGCC TTCTCACCGTCGCTTCGGCTGTCATCGCAGTCCTGTG GGGTAGGCCAAGCGAGGTCACAGGAGAAAATGAGG CTCAGCATGAT | 328 |
| AS53 | TTTGGCCTCACCACACTTGCAGGTAGAAGCTCCCAC GGGACCTCAGGACTGAGGGCAGCCACACACACCAA GTCTGGGGACGGTGGCCAGGGGGCTGCCAGGCAGT GTGAGAAGCTCCTGGAGCTGGCCCGGGCTACCAGA CCCTGGGGGAGGAGTACGTCAGCATCATCCAGGTG GACCCATCGCGGATACATGTGCCCTCCTCGCTGCGC CGTGGCGTGCTGG | 330 |
| AS54 | ATTATTGACAGCGACAAGATAATGGCAGTGTGCAT GGGGTGCCTGCTCACACGTCATGTGCAATGCCAGGC CATGGAGATGCAACAG | 332 |
| AS55 | GATGGCCACTCCTACACATCCAAGGTGAATTGTTTA CTCCTTCAAGATGGGTTCCATGGCTGTGTGAGCATC ACCGGGGCAGCTGGAAGAAGAAACCTGAGCATCTT CCTGTTCTTGATGCTGTGCAAATTGGAGTTCCATGC TTGT | 334 |
| AS56 | CTACTAAATGCAGAAGATTACCGGTGTGCCATTCAT TCAAAAGAGATTTATCTTCTTTCCCCCTCCCCCCACC AGGCAATGGACAAGTTTTCTCTCTGCTGCATCAACT GCAATCTATGTTTACATGTATTCCTTTTACTACTATT TTTTCAAAACAAAGATGTATGGCTTATTTCAAACAT CATTTTACTTTGGATATATGGCGGTATT | 336 |
| AS57 | ACAGGGGGCAAAAGCACCTGCTCGGCTCCTGGCCC TCAGTCTCTCCCCTCCACTCCATTCTCCACCTACCCA CAGTGGGTCATTCTGATCACCGAACTG | 338 |
| AS58 | GTGGAGACCCTGGAGAATGCCAACAGCTTCTCCAG CGGGATCCAGCCACTCCTCTGTTCCCTGATTGGCCT GGAGAATCCCACC | 340 |
| AS59 | GCTGGGGCTGGAACAATTTCCGAAGGTAGTGTTCTC CATGGTCAGAGGCTGGAGTGTGATGCCAGACGTTTT TTTGGGTGTGGGACTACAATACTGGCAGAGTGGGA GCACCAT | 342 |
| AS55.1 | GATGGCCACTCCTACACATCCAAGGTGAATTGTTTA CTCCTTCAAGATGGGTTCCATGGCTGTGTGAGCATC ACCGGGGCAGCTGGAAGAAGAAACCTGAGCATCTT CCTGTTCTTGATGCTGTGCAAATTGGAGTTCCATGC T | 386 |

TABLE 10

| Neoepitope ID | TCGA (%) | SU2C (%) |
|---|---|---|
| AS1 | 28.5 | 2.3 |
| AS2 | 18.5 | N.O. |
| AS3 | 10.4 | 25.6 |
| AS4 | 27.4 | 41.9 |
| AS5 | 18.7 | 9.3 |
| AS6 | 5.1 | 16.3 |
| AS7 | 5.1 | 16.3 |
| AS8 | N.O. | 14.0 |
| AS9 | 1.2 | 18.6 |
| AS10 | 8.9 | 27.9 |
| AS11 | 1.2 | 48.8 |
| AS12 | 0.4 | 34.9 |
| AS13 | 5.7 | 32.6 |
| ASM | N.O. | 30.2 |
| AS15 | 4.5 | 46.5 |
| AS16 | 0.6 | 18.6 |
| AS17 | N.O. | 37.2 |
| AS18 | 12.6 | 20.9 |
| AS19 | 12.6 | 20.9 |
| AS20 | 0.2 | 16.3 |
| AS21 | N.O. | 11.6 |
| AS22 | 0.2 | 20.9 |
| AS23 | 3.1 | 18.6 |
| AS32 | 57.1 | N.O. |
| AS33 | 47.6 | N.O. |
| AS34 | N.O. | 42.9 |
| AS35 | N.O. | 42.9 |
| AS36 | N.O. | 40.5 |
| AS37 | N.O. | 38.1 |
| AS38 | N.O. | 35.7 |
| AS39 | N.O. | 33.3 |
| AS40 | N.O. | 33.3 |

TABLE 10-continued

| Neoepitope ID | TCGA (%) | SU2C (%) |
|---|---|---|
| AS41 | N.O. | 33.3 |
| AS42 | N.O. | 33.3 |
| AS43 | N.O. | 31 |
| AS44 | N.O. | 28.6 |
| AS45 | N.O. | 26.2 |
| AS46 | N.O. | 26.2 |
| AS47 | N.O. | 23.8 |
| AS48 | N.O. | 23.8 |
| AS49 | N.O. | 23.8 |
| AS50 | N.O. | 23.8 |
| AS51 | N.O. | 23.8 |
| AS52 | 15.9 | 38.1 |
| AS53 | 16 | 9.5 |
| AS54 | 11.9 | N.O. |
| AS55 | 12.1 | N.O. |
| AS56 | 14.7 | N.O. |
| AS57 | 14.9 | N.O. |
| AS58 | 16.6 | N.O. |
| AS59 | 17.6 | N.O. |
| AS63 | 18.0 | |

N.O. not observed

Example 3: Identification of Additional Neoantigens Using Bioinformatics

Additional neoantigen sequences were identified by further queries as described in Example 2. Table 11 shows the amino acid sequences of the additional neoantigens. Table 12 shows the corresponding polynucleotide sequences.

TABLE 11

| Neoantigen ID | Gene(s) | Amino acid sequence | SEQ ID NO: |
|---|---|---|---|
| P16 | MSMB-NCOA4 | GVPGD**STRRAVRRM**NTF | 343 |
| P17 | MSMB-NOCA4 | GVPGDSTR**RAVRRMNTF** | 343 |
| P19 | TMEM222-LOC644961 | WTP**IPVLTRWPL**PHPPPWRRATSCRM ARSSPSATSGSSVRRRCSSLPSWVWNL AASTRPRSTPS | 347 |
| P22 | SLC45A3-ELK4 | SLYHREK**QLIAMDSAI** | 349 |
| P27 | FAM126B-ORC2 | LHPQRETFTPRWSGANYWKLA**FPVGA EGTF**PAAATQRGVVRPA | 351 |
| P35 | TMPRSS2-ERG | **NSKMALNS**LNSIDDAQLTRIAPPRSHC CFWEVNAP | 353 |
| P37 | TSTD1-F11R | MAG**GVLRRLLCR**EPDRDGDKGASRE ETVVPLHIGDPVVLPGIGQCYSALF | 355 |
| P46 | TP53 (R213D) | DDRNTFDIVWW**CPMSRLRLAL**TVPPS TTTTCVTVPAWAA | 357 |
| P48 | AR.p.H875Y | VQPIAREL**YQFTFDLLI** | 359 |
| P50 | AR (W742C) | QMAV**IQYSCMGLM**VFAM | 361 |
| P56 | SPOP (F102C) | PKSEV**RAKCICFSIL**NAK | 363 |
| P58 | AR (Q903H) | MMAEHSV**HVPKILSGK** | 365 |
| P59 | FOXA1 (F254V) | LHPDSG**NMVENGCYL**RR | 367 |
| P60 | FOXA1.p.F266L | C**YLRRQICRLK**CEKQPGA | 369 |
| P61 | FOXA1.p.R261G | MFENG**CYLGRQICRF**KCE | 371 |
| P73 | TP53 (G266E) | DSSGN**LLERNSFEV**RV | 373 |

TABLE 11-continued

| Neoantigen ID | Gene(s) | Amino acid sequence | SEQ ID NO: |
|---|---|---|---|
| P76 | AR-V3 | VFFKRAAEGFFRMNKLKESSDTNPKPY**CMAAPMGL**TENNRNRKKSYRETNLKAVSWPLNHT | 375 |
| P77 | AR-V3 | V**FFKRAAEGF**FRMNKLKESSDTNPKPYCMAAPMGLTENNRNRKKSYRETNLKAVSWPLNHT | 375 |
| P82 | AR-V7 | YEAGMTLGEKF**RVGNCKHLK**MTRP | 379 |
| P87 | AR-Intron | YEAGMTLGGKILF**FLFLLLPLS**PFSLIF | 381 |
| P97 | FOXRED2-TXN2 | GYLRMQG**LMAQRLLLR** | 383 |
| P98 | TP53 (R213D) | DDRNTFD**IVWWCPMSR**LRLALTVPPSTTTTCVTVPAWAA | 357 |

TABLE 12

| Neoantigen ID | Gene(s) | Nucleotide sequence | SEQ ID NO: |
|---|---|---|---|
| P16 | MSMB-NCOA4 | GGAGTTCCAGGAGATTCAACCAGGAGAGCAGTGAGGAGAATGAATACCTTC | 344 |
| P17 | MSMB-NOCA4 | GGAGTTCCAGGAGATTCAACCAGGAGAGCAGTGAGGAGAATGAATACCTTC | 344 |
| P19 | TMEM222-LOC644961 | TGGACGCCCATCCCGGTGCTCACGAGATGGCCACTACCACATCCTCCTCCCTGGAGAAGAGCTACAAGCTGCCGGATGGCCAGGTCATCACCATCAGCAACAAGCGGTTCCAGTGTCCGGAGGCGCTGTTCCAGCCTTCCTTCCTGGGTATGGAATCTTGCGGCATCCACGAGACCACGTTCAACTCCATCATGAA | 348 |
| P22 | SLC45A3-ELK4 | TCCCTCTACCACCGGGAGAAGCAGCTCATTGCTATGGACAGTGCTATC | 350 |
| P27 | FAM126B-ORC2 | CTTCATCCTCAGAGGGAAACATTCACTCCCCGGTGGTCGGGCGCGAATTACTGGAAATTGGCTTTTCCCGTTGGGGCCGAAGGTACCTTCCCTGCGGCGGCGACTCAGCGGGGTGTCGTTCGGCCGGCGTG | 352 |
| P35 | TMPRSS2-ERG | AACAGCAAGATGGCTTTGAACTCATTAAACTCCATTGATGATGCACAGTTGACAAGAATTGCCCCTCCAAGATCTCATTGCTGTTTCTGGGAAGTAAACGCTCCT | 354 |
| P37 | TSTD1-F11R | ATGGCTGGAGGAGTCCTTCGGCGGCTGTTGTGTCGGGAGCCTGATCGCGATGGGGACAAAGGCGCAAGTCGAGAGGAAACTGTTGTGCCTCTTCATATTGGCGATCCTGTTGTGCTCCCTGGCATTGGGCAGTGTTACAGTGCACTCTTCT | 356 |
| P46 | TP53 (R213D) | GATGACAGAAACACTTTCGACATAGTGTGGTGGTGCCCTATGAGCCGCCTGAGGTTGGCTCTGACTGTACCACCATCCACTACAACTACATGTGTAACAGTTCCTGCATGGGCGGCATGA | 358 |
| P48 | AR.p.H875Y | GTGCAGCCTATTGCGAGAGAGCTGCATCAGTTCACTTTTGACCTGCTAATC | 360 |
| P50 | AR (W742C) | CAGATGGCTGTCATTCAGTACTCCTGCATGGGGCTCATGGTGTTTGCCATG | 362 |

TABLE 12-continued

| Neoantigen ID | Gene(s) | Nucleotide sequence | SEQ ID NO: |
|---|---|---|---|
| P56 | SPOP (F102C) | CAAAGAGTGAAGTTCGGGCAAAATT CAAATGCTCCATCCTGAATGCCAAG | 364 |
| P58 | AR (Q903H) | ATGATGGCAGAGATCATCTCTGTGCA CGTGCCCAAGATCCTTTCTGGGAAA | 366 |
| P59 | FOXA1 (F254V) | CTGCACCCGGACTCCGGCAACATGG TCGAGAACGGCTGCTACTTGCGCCGC | 368 |
| P60 | FOXA1.p.F266L | TGCTACTTGCGCCGCCAGAAGCGCTT GAAGTGCGAGAAGCAGCCGGGGGCC | 370 |
| P61 | FOXA1.p.R261G | ATGTTCGAGAACGGCTGCTACTTGGG CCGCCAGAAGCGCTTCAAGTGCGAG | 372 |
| P73 | TP53 (G266E) | GACTCCAGTGGTAATCTACTGGAAC GGAACAGCTTTGAGGTGCGTGTT | 374 |
| P76 | AR-V3 | GTCTTCTTCAAAAGAGCCGCTGAAG GATTTTTCAGAATGAACAAATTAAA AGAATCATCAGACACTAACCCCAAG CCATACTGCATGGCAGCACCAATGG GACTGACAGAAAACAACAGAAATAG GAAGAAATCCTACAGAGAAACAAAC TTGAAAGCTGTCTCATGGCCTTTGAA TCATACT | 376 |
| P77 | AR-V3 | GTCTTCTTCAAAAGAGCCGCTGAAG GATTTTTCAGAATGAACAAATTAAA AGAATCATCAGACACTAACCCCAAG CCATACTGCATGGCAGCACCAATGG GACTGACAGAAAACAACAGAAATAG GAAGAAATCCTACAGAGAAACAAAC TTGAAAGCTGTCTCATGGCCTTTGAA TCATACT | 376 |
| P82 | AR-V7 | TATGAAGCAGGGATGACTCTGGGAG AAAAATTCCGGGTTGGCAATTGCAA GCATCTCAAAATGACCAGACCC | 380 |
| P87 | AR-Intron | TATGAAGCAGGGATGACTCTGGGAG GTAAGATACTTTTCTTTCTCTTCCTCC TCCTTCCTCTCTCCCCCTTCTCCCTCA TTTTC | 382 |
| P97 | FOXRED2-TXN2 | GGGTACCTGAGGATGCAGGGACTCA TGGCTCAGCGACTTCTTCTGAGG | 384 |
| P98 | TP53 (R213D) | GATGACAGAAACACTTTCGACATAG TGTGGTGGTGCCCTATGAGCCGCCTG AGGTTGGCTCTGACTGTACCACCATC CACTACAACTACATGTGTAACAGTTC CTGCATGGGCGGCATGA | 358 |

Example 4. HLA Binding Predictions

The amino acid sequences of the neoantigens identified using the various approaches as described in Example 3 were split into all possible unique, contiguous 9 mer amino acid fragments and HLA binding predictions to six common HLA alleles (HLA-A*01:01, HLA-A*02:01, HLA-A*03:01, HLA-A*24:02, HLA-B*07:02, HLA-B*08:01) were performed for each of these 9mers using netMHCpan4.0. Several 9 mer fragments were selected for further analysis based on ranking by likelihood of binding to one or more of the tested HLA alleles and their prevalence in prostate cancer patients.

Table 13 shows the amino acid sequences of select 9 mer fragments and their neoantigen origin. Table 14 shows the prevalence of neoantigens in the analyzed cohorts.

TABLE 13

| Neoantigen ID | Gene(s) | Type | Amino acid sequence or 9-mer | SEQ ID NO: of the 9mer |
|---|---|---|---|---|
| P16 | MSMB-NCOA4 | Fusion | STRRAVRRM | 387 |
| P17 | MSMB-NOCA4 | Fusion | RAVRRMNTF | 388 |

TABLE 13-continued

| Neoantigen ID | Gene(s) | Type | Amino acid sequence or 9-mer | SEQ ID NO: of the 9mer |
|---|---|---|---|---|
| P19 | TMEM222-LOC644961 | Fusion | IPVLTRWPL | 389 |
| P22 | SLC45A3-ELK4 | Fusion | QLIAMDSAI | 390 |
| P27 | FAM126B-ORC2 | Fusion | FPVGAEGTF | 391 |
| P35 | TMPRSS2-ERG | Fusion | NSKMALNSL | 392 |
| P37 | TSTD1-F11R | Fusion | GVLRRLLCR | 393 |
| P46 | TP53 (R213D) | Frameshift Mutation | CPMSRLRLA | 394 |
| P48 | AR.p.H875Y | Missense Mutation | YQFTFDLLI | 395 |
| P50 | AR (W742C) | Missense Mutation | IQYSCMGLM | 396 |
| P56 | SPOP (F102C) | Missense Mutation | RAKCKFSIL | 397 |
| P58 | AR (Q903H) | Missense Mutation | HVPKILSGK | 398 |
| P59 | FOXA1 (F254V) | Missense Mutation | NMVENGCYL | 399 |
| P60 | FOXA1.p.F266L | Missense Mutation | YLRRQKRLK | 400 |
| P61 | FOXA1.p.R261G | Missense Mutation | CYLGRQKRF | 401 |
| P73 | TP53 (G266E) | Missense Mutation | LLERNSFEV | 402 |
| P76 | AR-V3 | Splice Variant | YCMAAPMGL | 403 |
| P77 | AR-V3 | Splice Variant | FFKRAAEGF | 404 |
| P82 | AR-V7 | Splice Variant | RVGNCKHLK | 405 |
| P87 | AR-Intron | Splice Variant | FLFLLLPLS | 406 |
| P97 | FOXRED2-TXN2 | Fusion | LMAQRLLLR | 407 |
| P98 | TP53 (R213D) | Frameshift Mutation | IVWWCPMSR | 408 |

TABLE 14

| | | Prevalence | |
|---|---|---|---|
| Neoantigen ID | Gene | TCGA | SU2C |
| P16 | MSMB-NCOA4 | 27.16% | 23.25% |
| P17 | MSMB-NOCA4 | 27.16% | 23.25% |
| P19 | TMEM222-LOC644961 | N.O. | 13.95% |
| P22 | SLC45A3-ELK4 | 17.71% | 13.95% |
| P27 | FAM126B-ORC2 | 5.11% | 18.60% |
| P35 | TMPRSS2-ERG | 2.75% | 11.62% |
| P37 | TSTD1-F11R | 16.33% | 9.30% |
| P46 | TP53 (R213D) | N.O. | 1% |
| P48 | AR.p.H875Y | N.O. | 1% |
| P50 | AR (W742C) | N.O. | 1.25% |
| P56 | SPOP (F102C) | 0.40% | 2.00% |
| P58 | AR (Q903H) | N.O. | 1.00% |
| P59 | FOXA1 (F254V) | 0.20% | 1.00% |
| P60 | FOXA1.p.F266L | 0.20% | 1% |
| P61 | FOXA1.p.R261G | 0.20% | 1% |

TABLE 14-continued

| | | Prevalence | |
|---|---|---|---|
| Neoantigen ID | Gene | TCGA | SU2C |
| P73 | TP53 (G266E) | N.O. | 1% |
| P76 | AR-V3 | Present | Present |
| P77 | AR-V3 | Present | Present |
| P82 | AR-V7 | Present | Present |
| P87 | AR-Intron | Present | Present |
| P97 | FOXRED2-TXN2 | 3.74% | 11.62% |
| P98 | TP53 (R213D) | 0.00% | 1.00% |

Figure 5A:
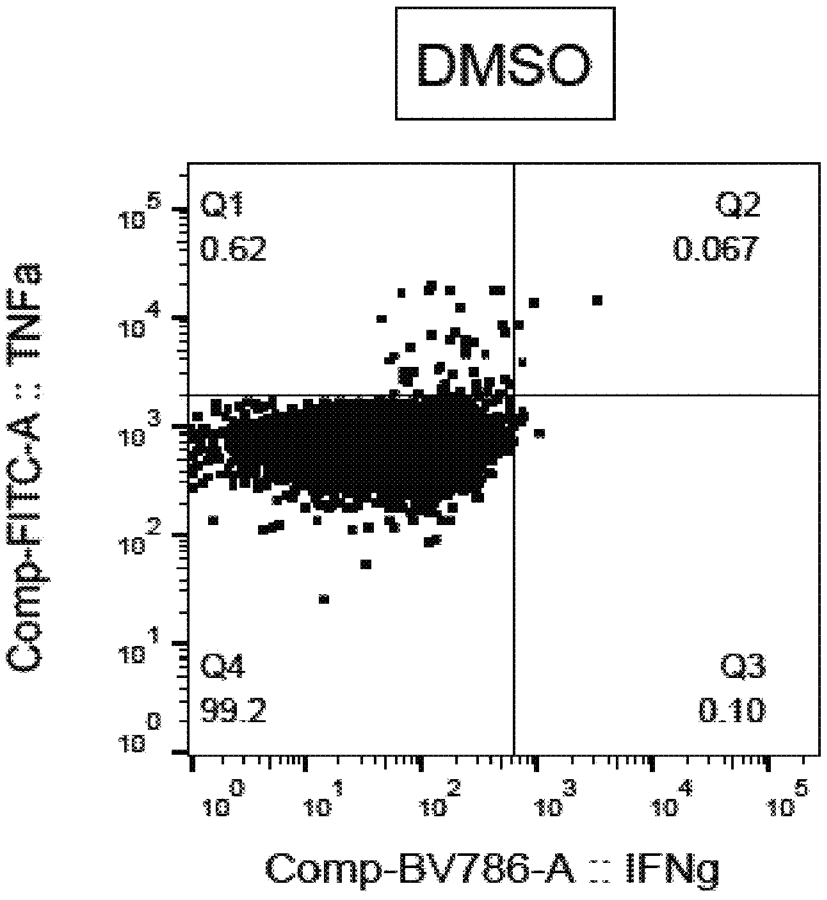
FIG. 5A shows an exemplary flow cytometry dot plot depicting $TNF\alpha^{+}IFN\gamma^{+}CD8^{+}$ T cell frequencies in PBMC samples after no stimulation (DMSO).
Figure 5B:
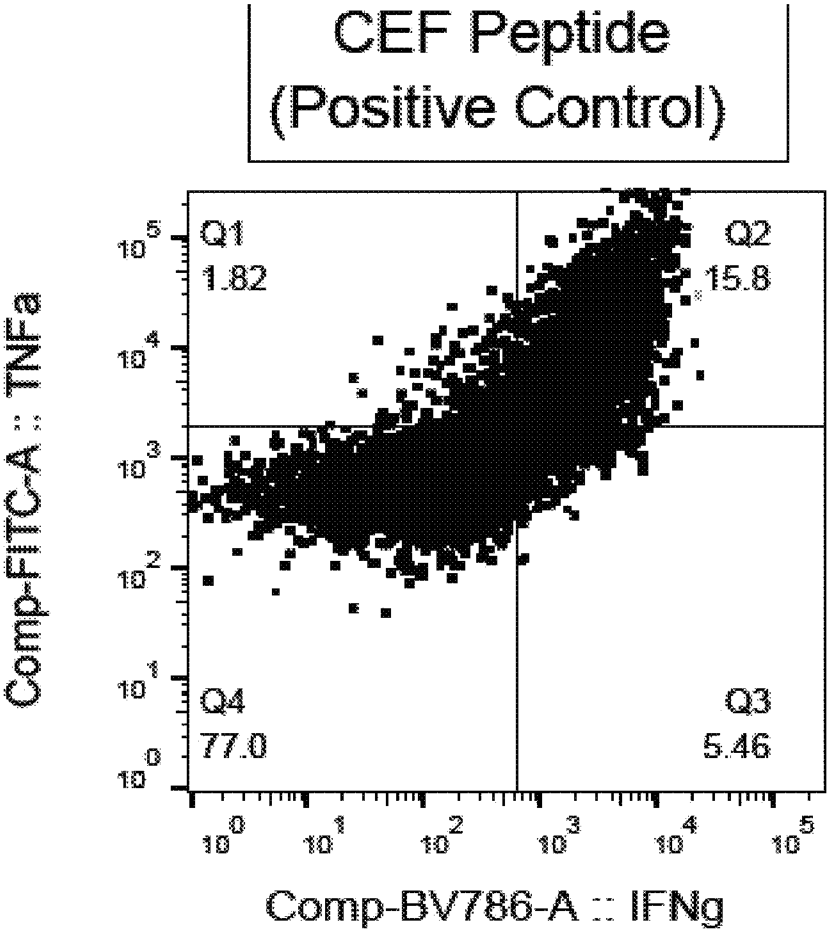
FIG. 5B shows an exemplary flow cytometry dot plot depicting $TNF\alpha^{+}IFN\gamma^{+}CD8^{+}$ T cell frequencies in PBMC samples after stimulating with CEF peptide.
Figure 5C:
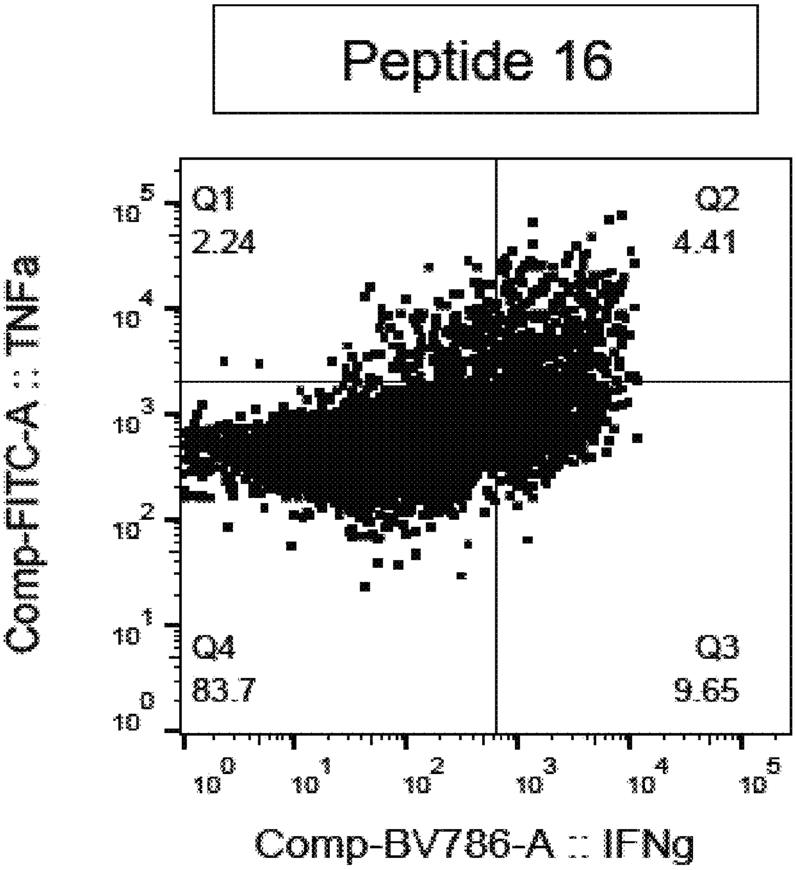
FIG. 5C shows an exemplary flow cytometry dot plot depicting $TNF\alpha^{+}IFN\gamma^{+}CD8^{+}$ T cell frequencies in PBMC samples after stimulation with P16.
Figure 5D:
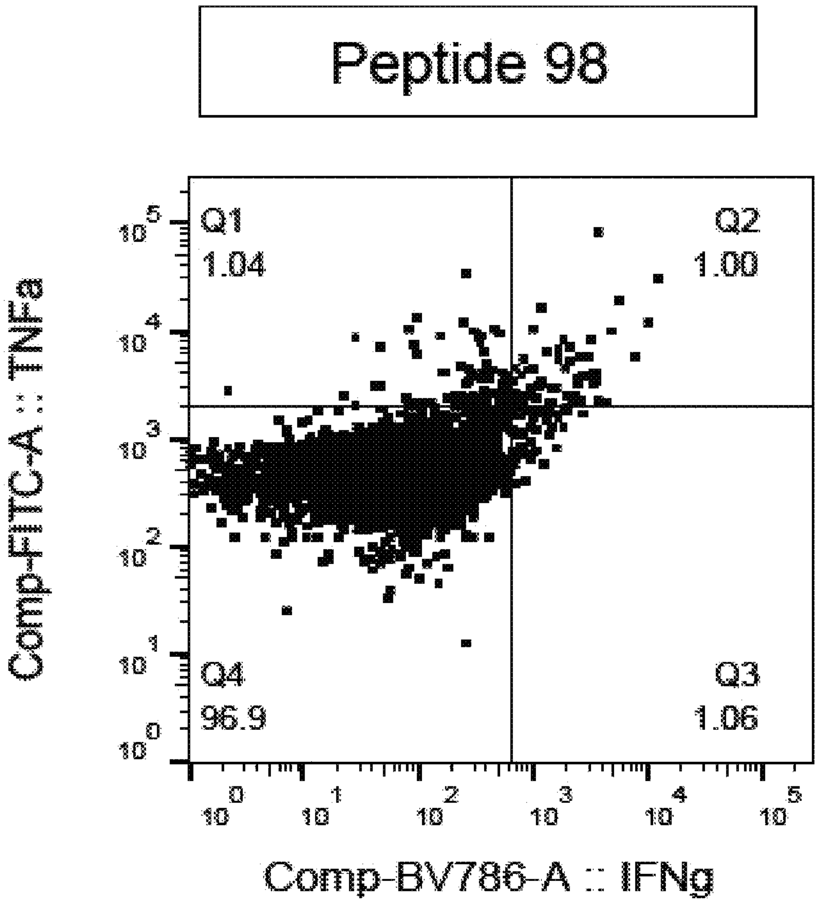
FIG. 5D shows an exemplary flow cytometry dot plot depicting $TNF\alpha^{+}IFN\gamma^{+}CD8^{+}$ T cell frequencies in PBMC samples after stimulation with P98.
Figure 5E:
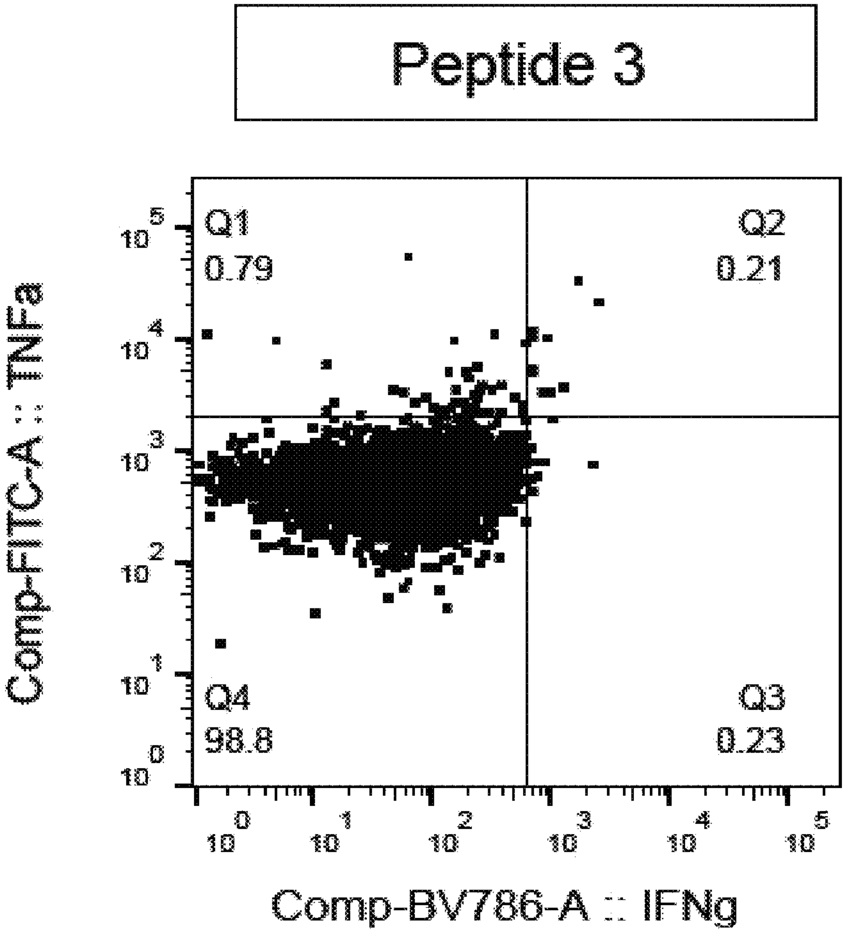
FIG. 5E shows an exemplary flow cytometry dot plot depicting $TNF\alpha^{+}IFN\gamma^{+}CD8^{+}$ T cell frequencies in PBMC samples after stimulation with P3 self-antigen.
Figure 6:
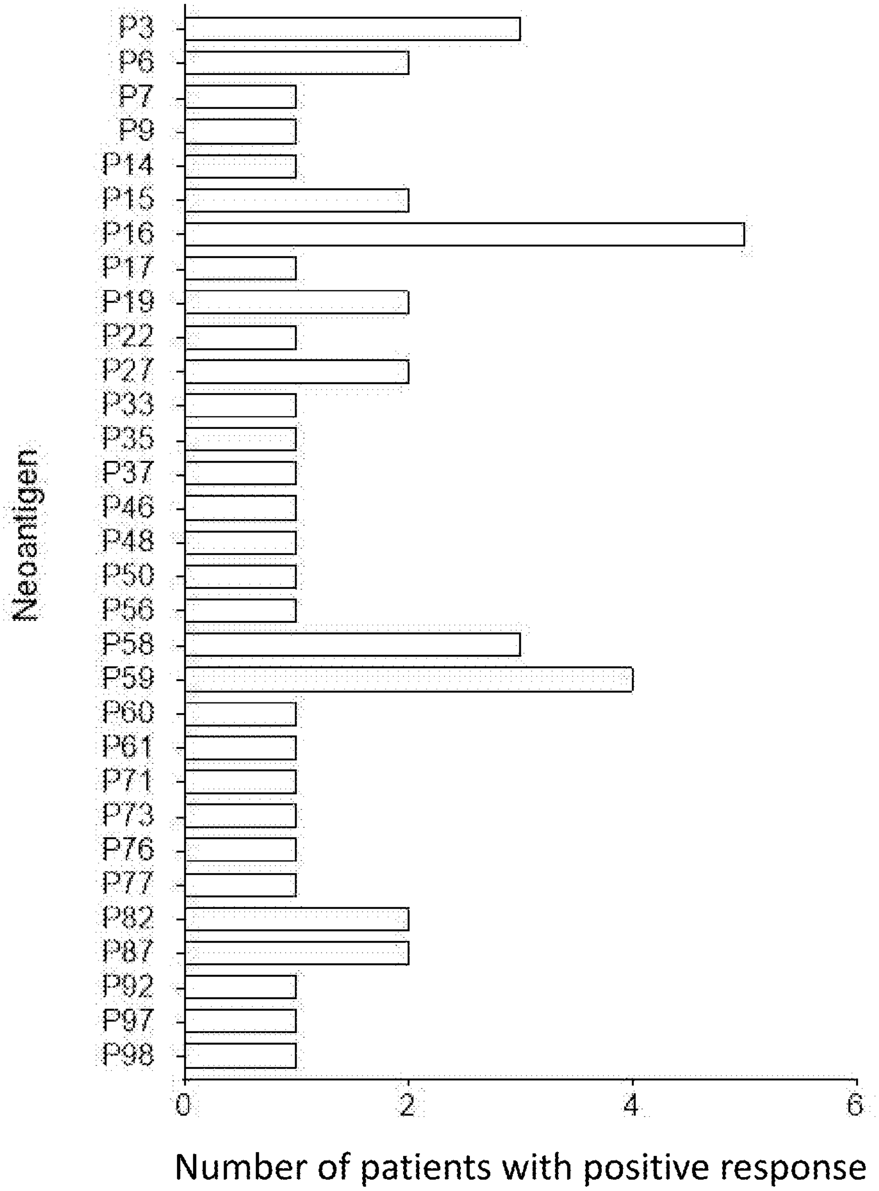
FIG. 6 shows the number of prostate cancer patients whose PBMC samples demonstrated a positive immune response to the specified neoantigens. P3, P6, P7, P9 and P92 represent self-antigens.

N.O.: not observed;

Present: AR splice variants were expressed at variable levels and hence prevalence was not determined Example 5. Immunogenicity Assessment of Neoantigens The 9 mer fragments shown in Table 13 were assessed for their ability to activate T cells using the Patient PBMC restimulation assay described in Example 1 using TNFα and IFNγ production by $CD8^+$ T cells as a readout. Self-antigens shown in Table 15 were also used in the assays. FIG. 5A, FIG. 5B, FIG. 5C, FIG. 5D and FIG. 5E show flow cytometry dot plots depicting $TNF\alpha^+IFN\gamma^+CD8^+$ T cell frequencies in PBMC samples after no stimulation (DMSO negative control) (FIG. 5A), after stimulation with CEF peptide (positive control (FIG. 5B), after stimulation with P16 (FIG. 5C), after stimulation with P98 (FIG. 5D), and after stimulation with P3 (FIG. 5E). Table 16 shows the maximum frequency of $TNF\alpha^+IFN\gamma^+CD8^+$ T cells and maximum fold change over negative control for each peptide analyzed, indicating the highest frequency of $TNF\alpha^+IFN\gamma^+CD8^+$ T cells and resulting fold change across the PBMC donors evaluated for the peptide. All neoantigens evaluated were found to stimulate $CD8^+$ T cells. FIG. 6 shows the number of prostate cancer patients whose PBMC samples demonstrated a positive immune response to the specified neoantigens. PBMCs from ten patients were evaluated.

TABLE 15

| Peptide ID | Gene name | Amino Acid Sequence of the 9-mer | SEQ ID NO: |
|---|---|---|---|
| P3 | ERG | KLSRALRYY | 421 |
| P6 | FOLH1 | MVFELANSI | 422 |
| P7 | ERG | ILFQNIDGK | 423 |
| P9 | FOLH1 | KIVIARYGK | 424 |
| P92 | ERG | FLLELLSDS | 425 |

TABLE 16

| Peptide Name | Maximum fold change over negative control | Maximum frequency of $TNF\alpha^+IFN\gamma^+CD8^+$ T cells (Percent) | Immunogenic |
|---|---|---|---|
| Negative control | n/a | 0.011-0.8 (depending on patient) | n/a |
| P16 | 65.82 | 4.620 | Yes |
| P17 | 2.17 | 0.130 | Yes |
| P19 | 5.00 | 0.480 | Yes |
| P22 | 5.00 | 0.120 | Yes |
| P27 | 3.43 | 0.430 | Yes |
| P35 | 2.67 | 0.064 | Yes |
| P37 | 3.13 | 1.160 | Yes |
| P46 | 2.33 | 0.140 | Yes |
| P48 | 2.33 | 0.220 | Yes |
| P50 | 5.14 | 0.190 | Yes |
| P56 | 11.57 | 1.620 | Yes |
| P58 | 19.18 | 5.370 | Yes |
| P59 | 10.75 | 3.010 | Yes |
| P60 | 2.08 | 0.340 | Yes |
| P61 | 2.27 | 0.084 | Yes |
| P73 | 2.97 | 0.110 | Yes |
| P76 | 2.30 | 0.170 | Yes |
| P77 | 3.24 | 0.160 | Yes |
| P82 | 3.46 | 0.970 | Yes |
| P87 | 3.24 | 0.120 | Yes |
| P97 | 4.55 | 0.160 | Yes |
| P98 | 14.93 | 1.000 | Yes |

Maximum frequency refers to the greatest frequency of $TNF\alpha^+IFN\gamma^+CD8^+$ T cells among all tested PBMC donors Example 6. Binding of Neoantigens to HLA Binding of select neoepitopes to HLA-A*01:01, HLA-A*02:01, HLA-A*03:01, HLA-A*24:02, HLA-B*07:02 and HLA-B*08:01 was evaluated using the assay described in Example 1. The results of binding the various neoantigens to HLA is shown in Table 17. Each HLA allele tested had a corresponding positive control (Pos) and a negative control (Neg) peptide against which the peptide of interest was exchanged. An exchange rate of 100% with Pos, thus means that the peptide of interest has the same binding affinity to the HLA allele as the positive control peptide. As a criterion for further evaluation, peptides with an exchange rate of at least 10% with the corresponding Pos peptide for at least one of the 6 HLA alleles that we considered for further evaluation. The exchange rates with the allele specific Pos peptides, of the 24 neoantigens so identified are summarized below in Table 17. Higher percentages correspond to stronger binding to the HLA allele.

TABLE 17

| Peptide Name | HLA-A*01:01 | HLA-A*02:01 | HLA-A*03:01 | HLA-A*24:02 | HLA-B*07:02 | HLA-B*08:01 |
|---|---|---|---|---|---|---|
| P16 | 5.5 | 10.4 | 6.1 | 0.8 | 13.7 | 6.2 |
| P17 | 4.9 | 9.3 | 3.8 | 0.1 | 38.7 | 9 |
| P19 | 5.2 | 8.2 | 4.1 | 0.1 | 91.3 | 14.5 |
| P22 | 4.4 | 46.9 | 4.8 | 0 | 8.3 | 3.9 |
| P27 | 4.8 | 10 | 4.5 | 0.7 | 7.8 | 6.4 |
| P35 | 2.5 | 12.5 | 4.2 | 0.2 | 12.1 | 13.7 |
| P37 | 1.4 | 12.5 | 6.4 | −0.1 | 9.4 | 3.3 |
| P46 | 2.4 | 14.4 | 10.3 | −0.4 | 64.8 | 14.5 |
| P48 | 4.3 | 99.3 | 4.4 | 0.1 | 12.8 | 8.9 |
| P50 | 2.3 | 8.8 | 5.5 | 0.1 | 10.4 | 4.7 |
| P56 | 2.6 | 8.4 | 6.8 | 0.5 | 82.5 | 38 |
| P58 | 2.5 | 11.8 | 32.5 | 0.2 | 9.7 | 5.3 |
| P59 | 2.2 | 11.9 | 4.5 | −0.5 | 7.5 | 5.5 |
| P60 | 3.1 | 7.9 | 36.6 | 0.9 | 6.1 | 10.2 |
| P61 | 1.7 | 5.8 | 2.1 | 90.3 | 9.6 | 3.6 |
| P73 | 2.1 | 89.2 | 3.5 | 0.5 | 8.7 | 2.6 |
| P76 | 0.1 | 85.9 | 6 | −0.5 | 91.5 | 8.5 |
| P77 | 1.9 | 9.6 | 2.8 | 1.7 | 14.2 | 3.4 |
| P82 | 1.5 | 6.3 | 58.1 | −0.1 | 12.9 | 1.4 |
| P87 | 1.1 | 64 | 2.4 | 0.2 | 5 | 3.1 |
| P97 | 2.5 | 4.6 | 39 | 0.1 | 7 | 2.7 |
| P98 | 2.5 | 7.9 | 51.1 | −0.1 | 6.7 | 2.4 |

Example 7. MHC I-Peptide Complex Profiling of Prostate Cancer Tissues Identified Unique MHC I-Presented Peptides in Prostate Cancer MHC I-peptide complexes were isolated from samples of 11 human prostate cancer and peptides presented by MHC I were identified using unbiased mass spectrometry. At collection, the subjects were diagnosed with grade 7 adenocarcinoma or stromal sarcoma with two subject having invasive adenocarcinoma.

Frozen human prostate cancer tissues with HLA-A*02:01, HLA-A*03:03, HLA-B*27:0 and HLA-B*08:01 haplotypes were mechanically disrupted in non-ionic detergent including protease inhibitors and processed. A pan-MHC allele monoclonal antibody was used to immunopurify MHC I-peptide complexes from the samples. After acid elution, recovery of the MHC I-peptide complexes was assessed by ELISA and recovered peptides desalted and subjected to LC-MS/MS analyses.

The raw LC-MS/MS data files from prostate tumors were analyzed to search against the neoantigen database that was created from corresponding RNAseq data obtained from the 11 human prostate cancer samples. These peptides had a theoretical mass for parent ions (MS1) and a list of theoretical fragment ions (MS2). A list of MS1 ions that had triggered MS2 scans were searched against the theoretical list of peptides and matched by mass. All theoretical peptides within a set MS1 ppm mass accuracy (5 ppm) then had their in silico MS2 spectrum compared to the empirical MS2 for that parent ion (peptide spectral matches or PSMs). A score was computed based on how closely the empirical spectrum matched the theoretical spectrum. Each LC-MS/MS run (one file per tumor sample) produced thousands of PSMs. However, the vast majority of these peptides were canonical sequences that were found in the human reference database (Swissprot). These were filtered out and peptides of interest (putative neoantigens) were compiled. From this list, peptides that had sufficient evidence for being positive were selected.

Table 18 shows the amino acid sequences of the peptides identified in complex with MHC I using LC-MS/MS and the gene origin of the peptides.

Table 19 shows the amino acid sequences of the corresponding longer neoantigens of the peptides identified in complex with MHC I using LC/MS/MS.

Table 20 shows the polynucleotide sequences encoding the corresponding longer neoantigens.

The MHC I complexed peptides described herein confirmed the expression, processing, and presentation of immunogenic epitopes specific to prostate cancer aberrant gene alterations. Evaluation of RNAseq databases mapped the identified MHC I complexed peptides within longer aberrant transcripts present in prostate cancer. Hence, these data identified prostate cancer neoantigens that contained at least one MHC class I epitope that is immunologically relevant and capable of eliciting an adaptive T cell response.

TABLE 18

| Neoantigen ID | Amino acid sequence | SEQ ID NO: | Gene | type |
|---|---|---|---|---|
| MS1 | VTFLKPCFLL | 426 | TTLL7 | Alternative 5' SS |
| MS2 | TDIVKQSV | 427 | CHD7 | Alternative Last Exon |
| MS3 | SPAFPKPVRP | 428 | TESK1 | Alternative Last Exon |
| MS4 | SYFSLTNIFNFV | 429 | PPIP5K2 | Alternative Last Exon |
| MSS | EFSPETCAFRLS | 430 | SRPK2 | Alternative Last Exon |
| MS6 | FLSRALRAL | 431 | SOAT1 | Alternative 5' SS |

TABLE 18-continued

| Neoantigen ID | Amino acid sequence | SEQ ID NO: | Gene | type |
|---|---|---|---|---|
| MS7 | KKDLELIL | 432 | PDE4D | Alternative Last Exon |
| MS8 | KLQKNCLL | 433 | ZYG11A | Exon Skip |
| MS9 | SALSGNSWV | 434 | SYNE2 | Alternative Last Exon |
| MS10 | TVRAILL | 435 | USP21 | Intron Retention |
| MS11 | GSLHFHEVLK | 436 | TDG | Novel Cassette |

TABLE 19

| Neoantigen ID | Gene ID | Peptide Sequence | Peptide SEQ ID NO: |
|---|---|---|---|
| MS1 | TTLL7 | **HYKLIQQP**ISLFSITDRLHKTFSQLPSVHLC SITFQWGHPPIFCSTNDICVTANFCISVTFL KPCFLLHEASASQ | 437 |
| MS2 | CHD7 | **WTDIVKQS**VSTNCISIKKGSYTKLFSLVFLI FCWPLIIQL | 438 |
| MS3 | TESK1 | **RTALTHNQ**DFSIYRLCCKRGSLCHASQAR SPAFPKPVRPLPAPITRITPQLGGQSDSSQP LLTTGRPQGWQDQALRHTQQASPASCATI TIPIHSAALGDHSGDPGPAWDTCPPLPLTT LIPRAPPPYGDSTARSWPSRCGPLG | 439 |
| MS4 | PPIP5K2 | **LRYGALCN**VSRISYFSLTNIFNFVIKSLTAI FTVKF | 440 |
| MS5 | SRPK2 | **RKERNIRK**SESTLRLSPFPTPAPSGAPAAA QGKVVRVPGPAGGLVPRDAGARLLPPAG GPGGGAAAGEGRAGRGRFPSITEPRPRDLP PRVATGRRAGGRRKGAGQGVRTRPLPAS WPGGRGPFRKGPRRLPLGSGPPAAGVQRL RCSHLSRGPRRRRGRVCGRACVSPPLPPRP PPVGLSAENLSWLSSGLPRACSWREFSPET CAFRLSGLDSKLSARVERDLGALRAPGSR AAQGGGRVRGSRSEWKTRPWRPPPAWPL TRAGGPLPKNPFLESCSETAQRRRVFSFST PLS | 441 |
| MS6 | SOAT1 | **YAYKDFLW**CFPFSLVFLQEIQICCHVSCLC CICCSTRICLGCLLELFLSRALRALHVLWN GFQLHCQ | 442 |
| MS7 | PDE4D | **SINKATIT**GKKDLELILHVSRKKPFLPRVNI TPTPISCCNLKMLKKFFLLYIIISIIDLTNCLS CYLEHFYRFTFFTDVHYF | 443 |
| MS8 | ZYG11A | **TMPAILKL**QKNCLLSL | 444 |
| MS9 | SYNE2 | **PYYSALSG**NSWVPSTLESDPFGYVFSPLAT RPALNDQESILWPTLTSVVSCALSCPSLNL PENWLTLITGGMKGGKKMKFTFRH | 445 |
| MS10 | USP21 | **GLRNLGNT**VRAILLSFLSKRNVKWCWGW GKPTSLGKACGRRALKLF | 446 |
| MS11 | TDG | **MEAENAGS**LHFHEVLKMGHVKF | 447 |

TABLE 20

| Neoantigen ID | Gene ID | Polynucleotide sequence | DNA SEQ ID NO: |
|---|---|---|---|
| MS1 | TTLL7 | **CACTACAAATTAATTCAACAACCCA**TATCCCT CTTCTCCATCACTGATAGGCTCCATAAGACGTT | 448 |

TABLE 20-continued

| Neoantigen ID | Gene ID | Polynucleotide sequence | DNA SEQ ID NO: |
|---|---|---|---|
| | | CAGTCAGCTGCCCTCGGTCCATCTCTGCTCAATCACCTTCCAGTGGGGACACCCGCCCATTTTCTGCTCAACAAATGATATCTGTGTCACGGCCAACTTCTGCATCTCGGTCACATTCCTTAAACCGTGCTTCCTCCTACATGAGGCATCTGCCTCACAG | |
| MS2 | CHD7 | **TGGACTGATATAGTTAAGCAGTC**TGTAAGTACAAACTGCATTTCTATCAAGAAAGGTAGCTATACAAAACTGTTTTCCTTAGTCTTTCTTATTTTCTGTTGGCCATTAATTATTCAGTTG | 449 |
| MS3 | TESK1 | **AGGACCGCCCTGACACACAATCAGG**ACTTCTCTATCTACAGGCTCTGTTGCAAGAGGGGGTCCCTCTGCCACGCTTCCCAGGCCAGATCCCCGGCTTTCCCGAAGCCGGTCAGACCTCTTCCTGCCCCCATCACCAGAATCACCCCCCAACTGGGGGGACAATCTGACTCGAGTCAACCCCTTCTCACTACGGGAAGACCTCAGGGGTGGCAAGATCAAGCTCTTAGACACACCCAGCAAGCCAGTCCTGCCTCTTGTGCCACCATCACCATTCCCATCCACTCAGCTGCCCTTGGTGACCACTCCGGAGACCCTGGTCCAGCCTGGGACACCTGCCCGCCGCTGCCGCTCACTACCCTCATCCCCCGAGCTCCCCCGCCGTATGGAGACAGCACTGCCAGGTCCTGGCCCTCCCGCTGTGGGCCCCTCGGC | 450 |
| MS4 | PPIP5K2 | **CTTCGCTATGGTGCCTTATGCAAT**GTAAGTAGAATAAGTTATTTCAGTCTAACAAATATATTTAATTTTGTAATTAAATCACTAACTGCTATTTTTACTGTGAAATTT | 451 |
| MS5 | SRPK2 | **CGAAAAGAGAGAAACATCCGAAAAA**GTGAGTCCACGCTGCGCCTGTCCCCGTTCCCCACCCCCGCCCCGTCGGGGGCGCCCGCGGCCGCGCAGGGGAAAGTTGTCCGGGTCCCCGGGCCGGCGGGCGGGCTGGTCCCCCGGGACGCTGGCGCTCGGCTCCTGCCCCCGGCGGGCGGCCCGGGGGGAGGGGCGGCGGCGGGGGAGGGGCGCGCGGGCCGCGGCCGGTTCCCTAGCATCACGGAGCCTCGACCCCGCGACCTCCCGCCCCGGGTCGCCACCGGCCGGCGGGCGGGAGGCCGGCGGAAAGGCGCCGGGCAGGGCGTGCGCACCCGTCCCTTGCCCGCGAGCTGGCCCGGGGGTCGCGGCCCTTTCCGGAAGGGGCCCCGGCGTCTGCCGCTGGGCTCCGGCCCGCCCGCTGCGGGAGTGCAGCGGCTGCGTTGCTCCCACCTGAGCCGCGGGCCGAGGAGGCGGAGGGGCCGAGTGTGCGGGAGGGCGTGTGTCTCGCCTCCCCTTCCTCCCCGGCCCCCGCCTGTCGGCCTTTCTGCTGAGAACCTAAGCTGGTTGTCAAGTGGTTTGCCTCGGGCGTGTTCCTGGCGCGAGTTCAGCCCCGAGACCTGTGCGTTTCGGCTCTCGGGTTTGGATTCGAAACTTTCCGCTCGGGTTGAGCGTGACTTGGGTGCGCTGCGGGCGCCGGGGTCGCGGGCTGCGCAGGGCGGTGGGCGTGTGCGCGGGAGCCGGTCGGAGTGGAAAACGCGCCCGTGGCGGCCACCTCCAGCCTGGCCGCTCACCCGAGCAGGGGGGCCGCTGCCCAAGAACCCTTTCCTGGAGAGCTGCTCCGAGACCGCACAGCGCCGCCGCGTCTTCTCCTTTTCCACTCCTCTCTCC | 452 |
| MS6 | SOAT1 | **TATGCTTACAAGGACTTTCTCTGG**TGTTTTCCTTTTTCTTTAGTTTTTCTCCAAGAGATTCAAATCTGCTGCCATGTTAGCTGTCTTTGCTGTATCTGCTGTAGTACACGAATATGCCTTGGCTGTTTGCTTGAGCTTTTTCTATCCCGTGCTCTTCGTGCTCTTCATGTTCTTTGGAATGGCTTTCAACTTCATTGTCAA | 453 |
| MS7 | PDE4D | **TCCATCAACAAAGCCACCATAACAG**GTAAGAAAGATCTGGAGCTTATTCTTCATGTGTCTAGGAAGAAACCATTTCTGCCAAGAGTCAATATAACACCAACACCAATTTCATGCTGCAATTTGAAAATGTTAAAGAAATTCTTTCTTCTCTACATTATCATTTCTATCATTGATCTCACAAATTGTCTAAGCTGTTATTTGGAACATTTTTACCGATTTACGTTTTTTACTGATGTACATTATTTT | 454 |

TABLE 20-continued

| Neoantigen ID | Gene ID | Polynucleotide sequence | DNA SEQ ID NO: |
|---|---|---|---|
| MS8 | ZYG11A | **ACCATGCCTGCTATTTTAAAG**TTACAGAAGA ATTGTCTTCTCTCCTTA | 455 |
| MS9 | SYNE2 | **CCATACTACAGCGCACTGTCAG**GTAACAGCT GGGTTCCCAGCACCCTGGAAAGTGACCCGTTT GGCTATGTTTTTAGCCCCTTAGCAACACGGCCA GCTCTCAATGACCAAGAGTCCATCTTGTGGCC GACCCTGACTTCTGTGGTTTCCTGTGCTCTATC CTGCCCATCTCTTAACTTACCTGAGAATTGGCT CACTCTCATCACAGGTGGAATGAAAGGGGGAA AAAAAATGAAATTCACATTCAGACAC | 456 |
| MS10 | USP21 | **GGCCTTCGAAACCTGGGAAACACG**GTGAGA GCTATTCTCCTATCTTTCCTCTCTAAAAGGAAT GTGAAATGGTGCTGGGGGTGGGGAAAACCCAC GAGCTTGGGGAAGGCATGTGGAAGGAGAGCTC TGAAGCTCTTC | 457 |
| MS11 | TDG | **ATGGAAGCGGAGAACGCGGGCAGT**TTGCAT TTTCATGAAGTGCTCAAAATGGGACATGTGAA ATTC | 458 |

Example 8. Expression Profiling of Prostate Neoantigens in Tumor and Normal Tissues The identified prostate neoantigens were profiled for their expression in about 90 FFPE tissue samples from prostate cancer (adenocarcinoma, clinical stages II-IV, Gleason score 8-9, subjects were treatment naïve or treated with CASODEX® (bicalutamide), LUPRON DEPOT® (leuprolide acetate for depot suspension) or FIRMAGON® (degarelix)) and a panel of normal tissues including liver, kidney, pancreas, ovary, prostate, mammary gland, colon, stomach, skeletal muscle and lung, in PBMCs obtained from healthy subjects and in prostate cancer cell lines including DU145-1, MDA-MB-436-1, LREX-1, 22RV1-1, H660-1. And other tissue cell lines including NCI-H2106-1, L-363-1, HCl-N87-1, OCI-AML5-1, MDA-PCa-2b-1 and GDM-1-1. Total RNA was extracted from formalin fixed paraffin embedded tissue samples using CELLDATA's RNAstorm-RNA isolation kit following kit protocol. RNA from cultured cell lines and PBMCs were isolated using Qiagen RNA isolation kits using standard methods. 200 ng of Total RNA from FFPE samples was used to prepare cDNA using High-capacity cDNA reverse transcription kit (ABI) and standard protocols. 37.5 ng cDNA was preamplified with gene markers in 15 μl preamplification mix using TaqMan preamplification kit (ThermoFisher Scientific) and standard protocols. To test gene expression of the identified neoantigens in the various samples, primers spanning the breakpoint sequences were designed for each of the identified prostate neoantigens and expression was assessed using Fluidigm Biomark™ HD. Percent (%) of expression positive FFPE prostate cancer samples were recorded for each neoantigen with relative average CT calculated in the prostate cancer samples. The results of the expression profiling of select neoantigens is shown in Table 21. The prevalence of each neoantigen in TCGA, SU2C and GTEx database is shown in Table 22.

TABLE 21

| | | | qPCR | | |
|---|---|---|---|---|---|
| Neoantigen ID | Amino acid SEQ ID NO: | Polynucleotide SEQ ID NO: | % Positive FFPE | Relative Average Ct | Normal Tissue Expression |
| AS18 | 275 | 276 | 95.6 | 6.3 | Ovary, Prostate |
| P87 | 381 | 382 | 85.6 | 8.3 | Ovary, Prostate |
| AS55 | 333 | 334 | 83.3 | 8.2 | Prostate |
| AS57 | 337 | 338 | 83.3 | 7.9 | Prostate |
| AS15 | 269 | 270 | 68.9 | 11.4 | Ovary, Mammary Gland |
| AS7 | 253 | 254 | 57.8 | 11.0 | None |
| AS43 | 309 | 310 | 52.2 | 11.2 | Mammary Gland |
| AS51 | 325 | 326 | 47.8 | 10.5 | Ovary |
| AS16 | 271 | 272 | 47.8 | 10.8 | Ovary |
| AS41 | 305 | 306 | 45.6 | 11.6 | Ovary |
| AS6 | 251 | 252 | 33.3 | 10.0 | None |
| AS3 | 245 | 246 | 26.7 | 10.8 | None |
| AS11 | 261 | 262 | 25.6 | 12.1 | None |
| AS13 | 265 | 266 | 21.1 | 11.1 | None |
| AS47 | 317 | 318 | 16.7 | 12.3 | Ovary |
| AS8 | 255 | 256 | 13.3 | 12.5 | None |
| AS19 | 277 | 278 | 95.6 | 6.3 | Ovary, Prostate |
| AS37 | 297 | 298 | 0.0 | N/A | None |
| AS23 | 285 | 286 | 22.0 | 13.0 | Ovary, Prostate, |

TABLE 21-continued

| | | | qPCR | | |
|---|---|---|---|---|---|
| Neoantigen ID | Amino acid SEQ ID NO: | Polynucleotide SEQ ID NO: | % Positive FFPE | Relative Average Ct | Normal Tissue Expression |
| | | | | | Mammary Gland |
| MS1 | 437 | 448 | N/A | N/A | None |
| MS3 | 439 | 450 | N/A | N/A | None |
| MS6 | 442 | 453 | N/A | N/A | None |
| MS8 | 444 | 455 | N/A | N/A | None |
| P82 | 379 | 380 | 37.0 | 11 | |
| P16 | 343 | 344 | 76 | 9 | Prostate |
| FUS1 | 211 | 212 | 72 | 9 | Prostate |
| P22 | 349 | 350 | 70 | 9 | Prostate |
| FUS2 | 213 | 214 | 55 | 11 | Mammary Gland |
| FUS3 | 215 | 216 | 43 | 11 | Prostate |
| FUS6 | 221 | 222 | 19 | 11 | None |
| FUS5 | 219 | 220 | 14 | 7 | None |
| FUS8 | 225 | 226 | 11 | 14 | None |
| FUS15 | 345 | 346 | 8 | 13 | None |
| P35 | 353 | 354 | 5 | 13 | None |
| FUS19 | 235 | 236 | 4 | 13 | None |
| FUS7 | 223 | 224 | 0 | N/A | None |
| M84 | 167 | 168 | N/A | N/A | N/A |
| M86 | 171 | 172 | N/A | N/A | N/A |
| M10 | 19 | 20 | N/A | N/A | N/A |
| M12 | 23 | 24 | N/A | N/A | N/A |
| FR1 | 177 | 178 | N/A | N/A | N/A |

TABLE 22

| Neoantigen ID | Amino acid SEQ ID NO: | Frozen prostate cancer tissues* (n = 11) | TCGA % | SU2C % | GTEx % |
|---|---|---|---|---|---|
| AS18 | 275 | 54.5 | 12.6 | 20.9 | 0.03 |
| P87 | 381 | 0.0 | 0 | 20.9 | 0 |
| AS55 | 333 | 18.2 | 12.1 | 0 | 0 |
| AS57 | 337 | 36.4 | 14.9 | 0 | 0 |
| AS15 | 269 | 36.4 | 4.5 | 46.5 | 0 |
| AS7 | 253 | 27.3 | 5.1 | 16.3 | 0 |
| AS43 | 309 | 0.0 | 0 | 31 | 0.4 |
| AS51 | 325 | 9.1 | 0 | 23.8 | 0.52 |
| AS16 | 271 | 45.5 | 0.6 | 18.6 | 0 |
| AS41 | 305 | 0.0 | 0 | 33.3 | 0.16 |
| AS6 | 251 | 27.3 | 5.1 | 16.3 | 0 |
| AS3 | 245 | 27.3 | 10.4 | 25.6 | 0.03 |
| AS11 | 261 | 9.1 | 1.2 | 48.8 | 0.07 |
| AS13 | 265 | 27.3 | 5.7 | 32.6 | 0 |
| AS47 | 317 | 0.0 | 0 | 23.8 | 0.05 |
| AS8 | 255 | 0.0 | 0 | 14 | 0 |
| AS19 | 277 | 54.5 | 12.6 | 20.9 | 0.03 |
| AS37 | 297 | 0.0 | 0 | 38.1 | 0 |
| AS23 | 285 | 45.5 | 3.1 | 18.6 | 0.09 |
| MS1 | 437 | 18.2 | 0 | 0 | 0 |
| MS3 | 439 | 9.1 | 0.197 | 0 | 0.13 |
| MS6 | 442 | 9.1 | 0.197 | 0 | 0 |
| MS8 | 444 | 18.2 | 0 | 0 | 0.016 |
| P82 | 379 | | Varied Expression | | |
| P16 | 343 | | 27.17 | 2.33 | 0.02 |
| FUS1 | 211 | | 17.72 | 13.95 | #N/A |
| P22 | 349 | | 30.51 | 23.26 | 0.03 |
| FUS2 | 213 | | 63.58 | 46.51 | 1.78 |
| FUS3 | 215 | | 35.04 | 23.26 | 0.02 |
| FUS6 | 221 | | 21.46 | 32.56 | #N/A |
| FUS5 | 219 | | 12.40 | 18.60 | #N/A |
| FUS8 | 225 | | 1.18 | 32.56 | 0.54 |
| FUS15 | 345 | | 0.39 | 9.30 | 0.11 |
| P35 | 353 | | 1.38 | 6.98 | #N/A |
| FUS19 | 235 | | 8.86 | 30.23 | 1.04 |
| FUS7 | 223 | | 3.35 | 16.28 | 0.51 |
| M84 | 167 | | | 1.28 | |
| M86 | 171 | | | 1.09 | |

TABLE 22-continued

| Neoantigen ID | Amino acid SEQ ID NO: | Frozen prostate cancer tissues* (n = 11) | TCGA % | SU2C % | GTEx % |
|---|---|---|---|---|---|
| M10 | 19 | | | 1.18 | |
| M12 | 23 | | | 0.99 | |
| FR1 | 177 | | | 0.30 | |

Example 9. Generation of Viral Vectors Encoding the Identified Neoantigens

The identified neoantigens were validated and prioritized for their inclusion into a universal prostate cancer vaccine. 41 of the identified neoantigens were selected to be included into the expression cassettes based on their expression across prostate cancer samples, low expression in normal tissues, binding to HLA, and immunogenicity. The selected 41 neoantigens are shown in Table 21 and Table 22 and include

AS18
(WKFEMSYTVGGPPPHVHARPRHWKTDR; SEQ ID NO: 275),

P87
(YEAGMTLGGKILFFLFLLLPLSPFSLIF; SEQ ID NO: 381),

AS55
(DGHSYTSKVNCLLLQDGFHGCVSITGAAGRRNLSIFLFLMLCKLEFHA
C; SEQ ID NO: 333),

AS57
(TGGKSTCSAPGPQSLPSTPFSTYPQWVILITEL; SEQ ID NO:
337),

AS15
(VLRFLDLKVRYLHS; SEQ ID NO: 269),

AS7
(DYWAQKEKGSSSFLRPSC; SEQ ID NO: 253),

AS43
(VPFRELKNVSVLEGLRQGRLGGPCSCHCPRPSQARLTPVDVAGPFLCLG
DPGLFPPVKSSI; SEQ ID NO: 309),

AS51
(GMECTLGQVGAPSPRREEDGWRGGHSRFKADVPAPQGPCWGGQPGSAPS
SAPPEQSLLD; SEQ ID NO: 325),

AS16
(GNTTLQQLGEASQAPSGSLIPLRLPLLWEVRG; SEQ ID NO:
271),

AS41
(EAFQRAAGEGGPGRGGARRGARVLQSPFCRAGAGEWLGHQSLR;
SEQ ID NO: 305),

AS6
(DYWAQKEKISIPRTHLC (SEQ ID NO: 251),

AS3
(VAMMVPDRQVHYDFGL (SEQ ID NO: 245),

AS11
(VPFRELKNQRTAQGAPGIHHAASPVAANLCDPARHAQHTRIPCGAGQVR
AGRGPEAGGGVLQPQRPAPEKPGCPCRRGQPRLHTVKMWRA; SEQ ID
NO: 261),

-continued

AS13
(KRSFAVTERII; SEQ ID NO: 265),

AS47
(FKKFDGPCGERGGGRTARALWARGDSVLTPALDPQTPVRAPSLTRAAAA
V; SEQ ID NO: 317),

AS8
(LVLGVLSGHSGSRL; SEQ ID NO: 255),

AS19
(QWQHYHRSGEAAGTPLWRPTRN; SEQ ID NO: 277),

AS37
(CHLFLQPQVGTPPPHTASARAPSGPPHPHESCPAGRRPARAAQTCARRQ
HGLPGCEEAGTARVPSLHLHLHQAALGAGRGRGWGEACAQVPPSRG;
SEQ ID NO: 297),

AS23
(KIQNKNCPD; SEQ ID NO: 285),

MS1
(HYKLIQQPISLFSITDRLHKTFSQLPSVHLCSITFQWGHPPIFCSTNDI
CVTANFCISVTFLKPCFLLHEASASQ; SEQ ID NO: 437),

MS3
(RTALTHNQDFSIYRLCCKRGSLCHASQARSPAFPKPVRPLPAPITRITP
QLGGQSDSSQPLLTTGRPQGWQDQALRHTQQASPASCATITIPIHSAALG
DHSGDPGPAWDTCPPLPLTTLIPRAPPPYGDSTARSWPSRCGPLG; SEQ
ID NO: 439),

MS6
(YAYKDFLWCFPFSLVFLQEIQICCHVSCLCCICCSTRICLGCLLELFLS
RALRALHVLWNGFQLHCQ; SEQ ID NO: 442),

MS8
(TMPAILKLQKNCLLSL; SEQ ID NO: 444),

P82
(YEAGMTLGEKFRVGNCKHLKMTRP; SEQ ID NO: 379).

P16
(GVPGDSTRRAVRRMNTF; SEQ ID NO: 343),

FUS1
(CGASACDVSLIAMDSA; SEQ ID NO: 211),

P22
(SLYHREKQLIAMDSAI; SEQ ID NO: 349),

FUS2
(TEYNQKLQVNQFSESK; SEQ ID NO: 213),

FUS3
(TEISCCTLSSEENEYLPRPEWQLQ; SEQ ID NO: 215),

FUS6
(CEERGAAGSLISCE; SEQ ID NO: 221),

-continued

FUSS
(NSKMALNSEALSVVSE; SEQ ID NO: 219),

FUS8
(WGMELAASRRFSWDHHSAGGPPRVPSVRSGAAQVQPKDPLPLRTLAGCL

ARTAHLRPGAESLPQPQLHCT; SEQ ID NO: 225),

FUS15
(HVVGYGHLDTSGSSSSSSWP; SEQ ID NO: 345),

P35
(NSKMALNSLNSIDDAQLTRIAPPRSHCCFWEVNAP; SEQ ID NO:

353),

FUS19
(KMHFSLKEHPPPPCPP; SEQ ID NO: 235),
and

FUS7
(LWFQSSELSPTGAPWPSRRPTWRGTTVSPRTATSSARTCCGTKWPSSQE

AALGLGSGLLRFSCGTAAIR; SEQ ID NO: 223),

M84
(IARELHQFAFDLLIKSH; SEQ ID NO: 167),

-continued

M86
(QPDSFAALHSSLNELGE; SEQ ID NO: 171),

M10
(FVQGKDWGLKKFIRRDF; SEQ ID NO: 19),

M12
(FVQGKDWGVKKFIRRDF; SEQ ID NO: 23),
and

FR1
(QNLQNGGGSRSSATLPGRRRRRWLRRRRQPISVAPAGPPRRPNQKPNPP

GGARCVIMRPTWPGTSAFT; SEQ ID NO: 177).

Expression cassettes were designed for cloning into viral backbones Modified Vaccinia Ankara (MVA) and Great Ape Adenovirus 20 (GAd20) by joining the 41 neoantigen sequences one after the other without any linker. Each neoantigen sequences was codon-optimized for expression in either MVA or GAd20. The optimized polynucleotide sequences are shown in Table 23 for GAd20 and Table 24 for MVA expression. GAd20 and MVA codon optimized sequences can also be used for expression in self-replicating RNA. Any of the optimized polynucleotide sequences shown in Tables 23 and 24, for example, can be cloned into a vector for the generation of a self-replicating RNA molecule as described herein.

TABLE 23

| Neoantigen ID | Gene ID | Amino acid SEQ ID NO: | Codon-optimized polynucleotide for GAd20 expression; SEQ ID NO: | Codon-optimized polynucleotide sequence for GAd20 expression |
|---|---|---|---|---|
| AS18 | NWD1 | 275 | 459 | TGGAAGTTCGAGATGAGCTACACCGT CGGCGGACCTCCACCTCATGTTCATG CCAGACCTCGGCACTGGAAAACCGAC AGA |
| P87 | AR-Intron | 381 | 460 | TATGAGGCCGGCATGACACTCGGCGG CAAGATCCTGTTCTTCCTGTTCCTGCT GCTCCCTCTGAGCCCCTTCAGCCTGAT CTTC |
| AS55 | SPOC | 333 | 461 | GATGGCCACAGCTACACCAGCAAAGT GAACTGCCTCCTGCTGCAGGATGGCT TCCACGGCTGTGTGTCTATTACTGGCG CCGCTGGCAGACGGAACCTGAGCATC TTTCTGTTTCTGATGCTGTGCAAGCTC GAGTTCCACGCCTGC |
| AS57 | KLK3 | 337 | 462 | ACAGGCGGCAAGTCCACATGTTCTGC CCCTGGACCTCAGAGCCTGCCTAGCA CACCCTTCAGCACATACCCTCAGTGG GTCATCCTGATCACCGAACTC |
| AS15 | LRRC45 | 269 | 463 | GTGCTGAGATTCCTGGACCTGAAAGT GCGCTACCTGCACAGC |
| AS7 | ACSM1 | 253 | 464 | GACTATTGGGCTCAAAAAGAGAAGGG CAGCAGCAGCTTCCTGCGGCCTAGCT GT |
| AS43 | CPNE7 | 309 | 465 | GTCCCCTTCAGAGAGCTGAAGAACGT TTCCGTGCTGGAAGGCCTGAGACAGG GCAGACTTGGCGGCCCTTGTAGCTGT CACTGCCCCAGACCTAGTCAGGCCAG ACTGACACCTGTGGATGTGGCCGGAC CTTTCCTGTGTCTGGGAGATCCTGGCC TGTTTCCACCTGTGAAGTCCAGCATC |
| AS51 | CPNE7 | 325 | 466 | GGCATGGAATGCACCCTGGGACAAGT GGGAGCCCCATCTCCTAGAAGAGAAG AGGATGGCTGGCGCGGAGGCCACTCT |

TABLE 23-continued

| Neoantigen ID | Gene ID | Amino acid SEQ ID NO: | Codon-optimized polynucleotide for GAd20 expression; SEQ ID NO: | Codon-optimized polynucleotide sequence for GAd20 expression |
|---|---|---|---|---|
| | | | | AGATTCAAAGCTGATGTGCCCGCTCC<br>TCAGGGCCCTTGTTGGGGAGGACAAC<br>CTGGATCTGCCCCATCTTCTGCCCCAC<br>CTGAACAGTCCCTGCTGGAT |
| AS16 | LRRC45 | 271 | 467 | GGCAACACAACCCTCCAGCAACTGGG<br>AGAAGCCTCTCAGGCTCCTAGCGGCT<br>CTCTGATCCCTCTCAGACTGCCTCTCC<br>TGTGGGAAGTTCGGGGC |
| AS41 | RHPN1 | 305 | 468 | GAGGCTTTCCAAAGAGCTGCTGGCGA<br>AGGCGGACCTGGTAGAGGTGGTGCTA<br>GAAGAGGTGCTAGGGTGCTGCAGAGC<br>CCATTCTGTAGAGCAGGCGCAGGCGA<br>ATGGCTGGGCCATCAGAGTCTGAGA |
| AS6 | ACSM1 | 251 | 469 | GATTATTGGGCCCAGAAAGAAAAGAT<br>CAGCATCCCCAGAACACACCTGTGC |
| AS3 | DNAH8 | 245 | 470 | GTGGCCATGATGGTGCCCGATAGACA<br>GGTCCACTACGACTTTGGACTG |
| AS11 | CPNE7 | 261 | 471 | GTGCCCTTCCGGGAACTGAAGAACCA<br>GAGAACAGCTCAGGGCGCTCCTGGAA<br>TCCACCATGCTGCTTCTCCAGTGGCCG<br>CCAACCTGTGTGATCCTGCCAGACAT<br>GCCCAGCACACCAGGATTCCTTGTGG<br>CGCTGGACAAGTGCGCGCTGGAAGAG<br>GACCTGAAGCAGGCGGAGGTGTTCTG<br>CAACCTCAAAGACCCGCTCCTGAGAA<br>GCCTGGCTGCCCTTGCAGAAGAGGAC<br>AGCCTAGACTGCACACCGTGAAAATG<br>TGGCGAGCC |
| AS13 | GRIN3A | 265 | 472 | AAGAGAAGCTTTGCCGTGACCGAGCG<br>GATCATC |
| AS47 | AGRN | 317 | 473 | TTCAAGAAGTTCGACGGCCCTTGCGG<br>AGAAAGAGGCGGAGGCAGAACAGCT<br>AGAGCCCTTTGGGCTAGAGGCGACAG<br>CGTTCTGACACCAGCTCTGGACCCTC<br>AGACACCTGTTAGGGCCCCTAGCCTG<br>ACAAGAGCTGCCGCCGCTGTG |
| AS8 | CACNA1D | 255 | 474 | CTGGTGCTGGGAGTGCTGTCTGGACA<br>CTCTGGCAGCAGACTG |
| AS19 | NWD1 | 277 | 475 | CAGTGGCAGCACTATCACAGATCTGG<br>CGAAGCCGCCGGAACACCCCTTTGGA<br>GGCCAACAAGAAAC |
| AS37 | RECQL4 | 297 | 476 | TGCCACTTGTTTCTGCAGCCCCAAGTG<br>GGCACACCTCCTCCACATACAGCCTC<br>TGCTAGAGCACCTAGCGGCCCTCCAC<br>ATCCTCACGAATCTTGTCCTGCCGGA<br>AGAAGGCCTGCCAGAGCCGCTCAAAC<br>ATGTGCCAGACGACAGCACGGACTGC<br>CTGGATGTGAAGAGGCTGGAACAGCC<br>AGAGTGCCTAGCCTGCACCTCCATCT<br>GCATCAGGCTGCTCTTGGAGCCGGAA<br>GAGGTAGAGGATGGGGCGAAGCTTGT<br>GCTCAGGTGCCACCTTCTAGAGGC |
| AS23 | ZNF614 | 285 | 477 | AAGATCCAGAACAAGAACTGCCCCGA<br>C |
| MS1 | TTLL7 | 437 | 478 | CACTACAAGCTGATCCAGCAGCCAAT<br>CAGCCTGTTCAGCATCACCGACCGGC<br>TGCACAAGACATTCAGCCAGCTGCCA<br>AGCGTGCACCTGTGCTCCATCACCTTC<br>CAGTGGGGACACCCTCCTATCTTTTGC<br>TCCACCAACGACATCTGCGTGACCGC<br>CAACTTCTGTATCAGCGTGACCTTCCT |

TABLE 23-continued

| Neoantigen ID | Gene ID | Amino acid SEQ ID NO: | Codon-optimized polynucleotide for GAd20 expression; SEQ ID NO: | Codon-optimized polynucleotide sequence for GAd20 expression |
|---|---|---|---|---|
| | | | | GAAGCCTTGCTTTCTGCTGCACGAGG CCAGCGCCTCTCAG |
| MS3 | TESK1 | 439 | 479 | CGAACCGCTCTGACACACAACCAGGA CTTCAGCATCTACAGACTGTGTTGCA AGCGGGGCTCCCTGTGCCATGCAAGC CAAGCTAGAAGCCCCGCCTTTCCTAA ACCTGTGCGACCTCTGCCAGCTCCAA TCACCAGAATTACCCCTCAGCTCGGC GGCCAGAGCGATTCATCTCAACCTCT GCTGACCACCGGCAGACCTCAAGGCT GGCAAGACCAAGCTCTGAGACACACC CAGCAGGCTAGCCCTGCCTCTTGTGC CACCATCACAATCCCCATCCACTCTGC CGCTCTGGGCGATCATTCTGGCGATC CTGGACCAGCCTGGGACACATGTCCT CCACTGCCACTCACAACACTGATCCC TAGGGCTCCTCCACCTTACGGCGATTC TACCGCTAGAAGCTGGCCCAGCAGAT GTGGACCACTCGGA |
| MS6 | SOAT1 | 442 | 480 | TACGCCTACAAGGACTTCCTGTGGTG CTTCCCCTTCTCTCTGGTGTTCCTGCA AGAGATCCAGATCTGCTGTCATGTGT CCTGCCTGTGCTGCATCTGCTGTAGCA CCAGAATCTGCCTGGGCTGTCTGCTG GAACTGTTCCTGAGCAGAGCCCTGAG AGCACTGCACGTGCTGTGGAACGGAT TCCAGCTGCACTGCCAG |
| MS8 | ZYG11A | 444 | 481 | ACAATGCCCGCCATCCTGAAGCTGCA GAAGAATTGCCTCCTAAGCCTG |
| P82 | AR-V7 | 379 | 482 | TACGAAGCCGGGATGACCCTGGGCGA GAAGTTCAGAGTGGGCAACTGCAAGC ACCTGAAGATGACCCGGCCT |
| P16 | MSMB-NCOA4-1 | 343 | 483 | GGCGTGCCAGGCGATAGCACTCGGAG AGCCGTCAGACGGATGAACACCTTT |
| FUS1 | SLC45A3->ELK4-1 | 211 | 484 | TGTGGCGCCTCTGCCTGTGACGTGTCC CTGATCGCTATGGACTCCGCC |
| P22 | SLC45A3-ELK4 - 2 | 349 | 485 | AGCCTGTACCACCGGGAAAAGCAGCT CATTGCCATGGACAGCGCCATC |
| FUS2 | ARHGEF38->ARHGEF38-IT1 | 213 | 486 | ACCGAGTACAACCAGAAACTGCAAGT GAACCAGTTCAGCGAGAGCAAG |
| FUS3 | MSMB->NCOA4-2 | 215 | 487 | ACCGAGATCAGCTGCTGCACCCTGAG CAGCGAGGAAAACGAGTACCTGCCTA GACCTGAGTGGCAGCTGCAG |
| FUS6 | TMPRSS2->ERG | 221 | 488 | TGCGAAGAGAGAGGCGCCGCAGGAT CTCTGATCTCCTGCGAA |
| FUSS | TMPRSS2->ERG | 219 | 489 | AACAGCAAGATGGCCCTGAATAGCGA GGCCCTGTCTGTGGTGTCTGAA |
| FUS8 | INCA1->CAMTA2 | 225 | 490 | TGGGGCATGGAACTGGCCGCCAGCAG AAGATTCAGCTGGGATCATCATAGCG CAGGCGGCCCACCTAGAGTGCCATCT GTTAGAAGCGGAGCTGCCCAGGTGCA GCCTAAAGATCCTCTGCCACTGAGAA CACTGGCCGGCTGCCTTGCTAGAACA GCCCATCTTAGACCTGGCGCCGAGTC TCTGCCTCAGCCACAACTGCACTGTA CC |
| FUS15 | D2HGDH->GAL3ST2 | 345 | 491 | CATGTCGTCGGCTACGGCCACCTGGA TACAAGCGGAAGCAGCTCTAGCTCCA GCTGGCCT |

TABLE 23-continued

| Neoantigen ID | Gene ID | Amino acid SEQ ID NO: | Codon-optimized polynucleotide for GAd20 expression; SEQ ID NO: | Codon-optimized polynucleotide sequence for GAd20 expression |
|---|---|---|---|---|
| P35 | TMPRSS2-ERG | 353 | 492 | AACTCAAAAATGGCTCTGAACAGCCT GAACTCCATCGACGACGCCCAGCTGA CAAGAATCGCCCCTCCTAGATCTCAC TGCTGCTTTTGGGAAGTGAACGCCCC A |
| FUS19 | GTF2F1-> PSPN | 235 | 493 | AAGATGCACTTTAGCCTGAAAGAACA CCCTCCACCACCTTGTCCTCCA |
| FUS7 | NME4-> DECR2 | 223 | 494 | CTGTGGTTCCAGTCCAGCGAGCTGTCT CCTACTGGTGCCCCTTGGCCATCTAGA CGCCCTACTTGGAGAGGCACCACCGT GTCACCAAGAACCGCCACAAGCAGCG CCAGAACCTGTTGTGGCACAAAGTGG CCCTCCAGCCAAGAAGCCGCTCTCGG ACTTGGAAGCGGACTGCTGAGGTTCT CTTGTGGAACCGCCGCCATTCGG |
| M84 | AR-T878A | 167 | 495 | ATCGCTAGAGAGCTGCACCAGTTCGC CTTCGACCTGCTGATCAAGAGCCAC |
| M86 | AR-L702H | 171 | 496 | CAGCCTGATTCTTTTGCCGCACTGCAC AGCTCCCTGAACGAGCTGGGAGAG |
| M10 | SPOP-F133L | 19 | 497 | TTCGTGCAAGGCAAGGATTGGGGCCT CAAAAAGTTTATCCGCAGAGACTTC |
| M12 | SPOP-W133V | 23 | 498 | TTTGTGCAGGGCAAAGACTGGGGCGT GAAGAAGTTCATCCGGCGGGACTTC |
| FR1 | ZFHX3 | 177 | 499 | CAGAACCTGCAGAACGGCGGAGGCTC TAGAAGCTCTGCTACACTTCCTGGCA GGCGGCGGAGAAGATGGCTGAGAAG AAGGCGGCAGCCTATCTCTGTGGCTC CTGCTGGACCTCCTAGACGGCCCAAC CAGAAGCCTAATCCTCCTGGCGGAGC CAGATGCGTGATCATGAGGCCTACAT GGCCTGGCACCAGCGCCTTCACC |

TABLE 24

| Neoantigen ID | Gene ID | Amino acid SEQ ID NO: | Codon-optimized polynucleotide for MVA expression; SEQ ID NO: | Codon-optimized polynucleotide sequence for MVA expression |
|---|---|---|---|---|
| AS18 | NWD1 | 275 | 500 | TGGAAGTTCGAGATGAGCTACACCG TTGGCGGCCCTCCACCACATGTTCA CGCCAGACCTAGACACTGGAAAACC GACAGA |
| P87 | AR-Intron | 381 | 501 | TACGAGGCCGGCATGACACTCGGAG GCAAGATCCTGTTCTTCCTGTTCCTG CTGCTCCCTCTGAGCCCCTTCAGCCT GATCTTT |
| AS55 | SPOC | 333 | 461 | GATGGCCACAGCTACACCAGCAAAG TGAACTGCCTCCTGCTGCAGGATGG CTTCCACGGCTGTGTGTCTATTACTG GCGCCGCTGGCAGACGGAACCTGAG CATCTTTCTGTTTCTGATGCTGTGCA AGCTCGAGTTCCACGCCTGC |
| AS57 | KLK3 | 337 | 503 | ACAGGCGGCAAGAGCACATGTTCTG CCCCTGGACCTCAGTCTCTGCCCAG CACACCCTTCAGCACATACCCTCAG TGGGTCATCCTGATCACCGAGCTG |

TABLE 24-continued

| Neoantigen ID | Gene ID | Amino acid SEQ ID NO: | Codon-optimized polynucleotide for MVA expression; SEQ ID NO: | Codon-optimized polynucleotide sequence for MVA expression |
|---|---|---|---|---|
| AS15 | LRRC45 | 269 | 504 | GTGCTGCGGTTCCTGGATCTCAAAG TGCGCTACCTGCACAGC |
| AS7 | ACSM1 | 253 | 505 | GATTATTGGGCCCAGAAAGAAAAG GGCAGCAGCAGCTTCCTGCGGCCTA GCTGT |
| AS43 | CPNE7 | 309 | 506 | GTGCCCTTCCGGGAACTGAAGAACG TGTCCGTTCTGGAAGGCCTGAGGCA GGGCAGACTTGGCGGACCTTGTAGC TGCCACTGTCCTAGACCAAGCCAGG CCAGACTGACCCCTGTGGATGTGGC TGGCCCATTTCTGTGTCTGGGCGAC CCTGGACTGTTCCCTCCAGTGAAGT CTAGCATC |
| AS51 | CPNE7 | 325 | 507 | GGCATGGAATGTACACTGGGCCAAG TGGGAGCCCCATCTCCTAGAAGAGA AGAGGATGGCTGGCGCGGAGGCCA CTCTAGATTCAAAGCTGATGTGCCC GCTCCTCAGGGCCCTTGTTGGGGAG GACAACCTGGATCTGCCCCATCTTC TGCCCCACCTGAACAGAGCCTGCTG GAT |
| AS16 | LRRC45 | 271 | 508 | GGCAACACCACACTGCAACAGCTGG GAGAAGCCTCTCAGGCCCCAAGCGG TTCTCTGATCCCTCTCAGACTGCCCC TCCTGTGGGAAGTGCGGGGC |
| AS41 | RHPN1 | 305 | 509 | GAGGCTTTCCAGAGAGCAGCTGGCG AAGGCGGACCTGGCAGAGGTGGTG CTAGAAGAGGTGCTAGAGTGCTGCA GAGCCCATTCTGTAGAGCTGGCGCT GGCGAATGGCTGGGCCACCAATCTC TTAGA |
| AS6 | ACSM1 | 251 | 510 | GACTATTGGGCTCAAAAAGAGAAG ATCAGCATCCCCAGAACACACCTGT GC |
| AS3 | DNAH8 | 245 | 511 | GTGGCCATGATGGTGCCCGACAGAC AGGTGCACTACGACTTCGGCCTG |
| AS11 | CPNE7 | 261 | 512 | GTGCCCTTCAGAGAGCTGAAAAACC AGAGAACAGCCCAGGGCGCTCCTGG AATCCATCATGCTGCTTCTCCAGTG GCCGCCAATCTGTGCGATCCTGCCA GACATGCCCAGCATACCAGGATTCC TTGTGGCGCTGGACAAGTGCGCGCT GGAAGAGGACCTGAAGCTGGTGGC GGAGTTCTGCAGCCTCAAAGACCTG CTCCTGAGAAGCCTGGCTGCCCCTG TAGAAGAGGACAGCCTAGACTGCAC ACCGTGAAGATGTGGCGGGCC |
| AS13 | GRIN3A | 265 | 513 | AAGAGAAGCTTCGCCGTGACCGAGC GGATCATC |
| AS47 | AGRN | 317 | 514 | TTTAAGAAGTTTGACGGCCCCTGCG GCGAGAGAGGCGGAGGAAGAACTG CAAGAGCCCTTTGGGCCAGAGGCGA CTCTGTTCTGACACCAGCTCTGGAC CCTCAGACACCTGTTAGGGCCCCTA GCCTGACAAGAGCTGCCGCTGCTGT T |
| AS8 | CACNA1D | 255 | 515 | CTGGTGCTGGGCGTGCTGTCTGGCC ACTCTGGAAGCAGACTG |
| AS19 | NWD1 | 277 | 516 | CAATGGCAGCACTACCACAGATCTG GCGAAGCCGCTGGAACCCCACTTTG GAGGCCTACCAGAAAC |

TABLE 24-continued

| Neoantigen ID | Gene ID | Amino acid SEQ ID NO: | Codon-optimized polynucleotide for MVA expression; SEQ ID NO: | Codon-optimized polynucleotide sequence for MVA expression |
|---|---|---|---|---|
| AS37 | RECQL4 | 297 | 517 | TGCCACTTGTTTCTCCAGCCACAAGT<br>GGGCACCCCTCCACCTCATACAGCC<br>TCTGCTAGAGCACCTAGCGGCCCAC<br>CTCATCCTCACGAATCTTGTCCTGCC<br>GGAAGAAGGCCTGCCAGAGCCGCTC<br>AAACATGTGCCAGACGACAGCACG<br>GACTGCCCGGATGTGAAGAAGCCGG<br>AACAGCCAGAGTGCCTAGCCTGCAC<br>CTTCATCTGCATCAGGCCGCTCTTGG<br>AGCCGGAAGAGGTAGAGGATGGGG<br>AGAAGCTTGTGCCCAGGTGCCACCT<br>TCTAGAGGC |
| AS23 | ZNF614 | 285 | 477 | AAGATCCAGAACAAGAACTGCCCCG<br>AC |
| MS1 | TTLL7 | 437 | 519 | CACTACAAGCTGATCCAGCAGCCAA<br>TCAGCCTGTTCTCCATCACCGACCG<br>GCTGCACAAGACATTCAGCCAGCTG<br>CCTTCCGTGCATCTGTGCAGCATCA<br>CCTTCCAGTGGGGACACCCTCCTAT<br>CTTTTGCTCCACCAACGACATCTGC<br>GTGACCGCCAACTTCTGTATCAGCG<br>TGACCTTCCTGAAGCCTTGCTTTCTG<br>CTGCACGAGGCCTCCGCCAGCCAG |
| MS3 | TESK1 | 439 | 520 | CGGACCGCTCTGACCCACAACCAGG<br>ACTTCAGCATCTACCGGCTGTGCTG<br>CAAGAGGGGCTCTCTGTGTCATGCT<br>AGCCAGGCTAGAAGCCCCGCCTTTC<br>CTAAGCCTGTCAGACCTCTGCCTGC<br>TCCTATCACCAGAATCACCCCTCAG<br>CTCGGCGGCCAGTCTGATTCATCTC<br>AGCCACTGCTGACCACCGGCAGACC<br>TCAAGGATGGCAAGACCAGGCTCTG<br>AGACACACACAGCAGGCTAGCCCA<br>GCCTCTTGCGCCACCATCACAATAC<br>CAATACATTCTGCCGCTCTGGGCGA<br>TCACAGCGGAGATCCTGGACCTGCC<br>TGGGATACTTGTCCTCCTCTGCCCCT<br>AACTACACTGATCCCTAGGGCTCCT<br>CCACCTTACGGCGATAGCACAGCCA<br>GATCCTGGCCTAGCAGATGTGGCCC<br>TCTGGGC |
| MS6 | SOAT1 | 442 | 521 | TACGCCTACAAGGACTTCCTGTGGT<br>GCTTCCCCTTCTCTCTGGTGTTCCTG<br>CAAGAAATCCAGATCTGCTGTCACG<br>TGTCCTGCCTGTGCTGTATCTGCTGT<br>AGCACCCGGATCTGTCTGGGCTGTC<br>TGCTGGAACTGTTCCTGAGCAGAGC<br>CCTGAGAGCACTGCACGTGCTGTGG<br>AACGGATTCCAGCTGCACTGCCAG |
| MS8 | ZYG11A | 444 | 522 | ACCATGCCTGCCATTCTGAAGCTGC<br>AGAAGAATTGTCTTCTAAGCCTG |
| P82 | AR-V7 | 379 | 523 | TATGAGGCTGGAATGACCCTGGGCG<br>AGAAGTTCAGAGTGGGCAACTGCAA<br>GCACCTGAAGATGACCCGGCCT |
| P16 | MSMB-NCOA4-1 | 343 | 524 | GGAGTGCCTGGCGATTCTACTAGAA<br>GGGCCGTGCGGCGGATGAACACCTT<br>T |
| FUS1 | SLC45A3-><br>ELK4 - 1 | 211 | 525 | TGTGGCGCATCTGCCTGCGACGTGT<br>CCCTGATCGCTATGGATAGCGCC |
| P22 | SLC45A3-<br>ELK4 - 2 | 349 | 485 | AGCCTGTACCACCGGGAAAAGCAGC<br>TCATTGCCATGGACAGCGCCATC |

TABLE 24-continued

| Neoantigen ID | Gene ID | Amino acid SEQ ID NO: | Codon-optimized polynucleotide for MVA expression; SEQ ID NO: | Codon-optimized polynucleotide sequence for MVA expression |
|---|---|---|---|---|
| FUS2 | ARHGEF38-> ARHGEF38-IT1 | 213 | 486 | ACCGAGTACAACCAGAAACTGCAA GTGAACCAGTTCAGCGAGAGCAAG |
| FUS3 | MSMB-> NCOA4-2 | 215 | 528 | ACCGAGATCAGCTGCTGCACCCTGA GCAGCGAGGAAAACGAGTACCTGC CTAGACCTGAATGGCAGCTGCAG |
| FUS6 | TMPRSS2-> ERG | 221 | 529 | TGCGAGGAAAGAGGCGCAGCCGGA TCTCTGATCTCTTGCGAG |
| FUSS | TMPRSS2-> ERG | 219 | 530 | AACAGCAAGATGGCCCTGAATAGCG AGGCCCTGTCTGTGGTGTCCGAG |
| FUS8 | INCA1-> CAMTA2 | 225 | 531 | TGGGGAATGGAACTGGCCGCTAGCA GGCGGTTTAGCTGGGATCATCATTC TGCCGGCGGACCTCCAAGAGTGCCA AGCGTTAGAAGCGGAGCAGCCCAG GTCCAGCCTAAAGATCCACTGCCAC TGAGAACACTGGCCGGCTGCCTTGC CAGAACAGCTCATCTTAGACCTGGC GCCGAAAGCCTGCCTCAACCTCAGC TGCATTGCACA |
| FUS15 | D2HGDH-> GAL3ST2 | 345 | 532 | CACGTTGTCGGCTATGGCCACCTGG ATACAAGCGGCTCCTCTAGCAGTAG CTCCTGGCCT |
| P35 | TMPRSS2- ERG | 353 | 533 | AATTCTAAGATGGCTCTCAACAGCC TGAACTCCATCGACGACGCCCAGCT GACAAGAATCGCCCCTCCAAGAAGC CACTGTTGCTTTTGGGAAGTGAACG CCCCT |
| FUS19 | GTF2F1-> PSPN | 235 | 534 | AAGATGCACTTCTCACTGAAAGAGC ACCCGCCACCGCCGTGCCCACCG |
| FUS7 | NME4-> DECR2 | 223 | 535 | CTGTGGTTCCAGTCCAGCGAACTGT CTCCTACTGGCGCTCCATGGCCAAG CAGAAGGCCTACTTGGAGAGGCACC ACCGTGTCTCCAAGAACCGCTACAA GCAGCGCCAGAACCTGTTGCGGCAC AAAATGGCCCTCCAGCCAAGAAGCT GCCCTCGGACTTGGAAGCGGACTGC TGAGATTCAGCTGTGGCACAGCCGC CATCAGA |
| M84 | AR-T878A | 167 | 536 | ATCGCCAGAGAACTGCACCAGTTCG CCTTCGACCTGCTGATCAAGAGCCA C |
| M86 | AR-L702H | 171 | 537 | CAGCCTGACAGCTTTGCTGCCCTGC ATAGCTCCCTGAATGAGCTGGGCGA A |
| M10 | SPOP-F133L | 19 | 538 | TTTGTGCAGGGTAAAGATTGGGGCC TCAAAAAGTTTATCAGACGGGACTT C |
| M12 | SPOP-W133V | 23 | 539 | TTCGTGCAGGGCAAAGACTGGGGCG TGAAGAAGTTCATCCGGCGGGACTT T |
| FR1 | ZFHX3 | 177 | 540 | CAGAACCTGCAGAACGGCGGAGGC TCTAGAAGCTCTGCTACACTTCCTG GCAGGCGGCGGAGAAGATGGCTGA GAAGAAGGCGGCAGCCTATCTCTGT GGCTCCTGCTGGACCTCCTAGACGG CCCAACCAGAAGCCTAATCCTCCTG GCGGAGCCAGATGCGTGATCATGAG GCCTACATGGCCTGGCACCAGCGCC TTTACC |

Synthetic Gene Design

The 41 neoantigen amino acidic sequences were joined head to tail. The order of the neoantigens sequences was determined according to a strategy that minimized the formation of predicted junctional epitopes that may be generated by the juxtaposition of two adjacent neoantigen peptides.

To this purpose, custom tools were developed to split the 41 neoantigens into 4 smaller lists (sublists) of similar cumulative length and to generate, for each sublist, 2 million scrambled layouts of the synthetic gene with a different neoantigen order. The tool proceeded iteratively. At each loop a scrambled layout was generated and compared to the layouts already generated. If the number of predicted junctional epitopes in the new layout was lower than the number of the previously best layout, the new layout was considered as the best. Each scrambled layout was analyzed estimating the number of potential junctional epitopes predicted to bind one out of a subset of 9 class I HLA haplotypes with an $IC_{50}$<=1500 nM (considering only 9mer epitopes predicted by the IEDB_recommended method included in the IEDB 2.17 software). The 9 class I HLA haplotypes cumulatively cover 82% of the world population as estimated by analyzing haplotypes annotated for subjects in the 1000 genomes project. Scrambled layouts with neoantigens that formed predicted junctional epitopes with the N-terminal T-cell enhancer or the C-terminal TAG sequence were excluded. As an additional constraint, in each layout junctions that contained a 9mer peptide that matched a protein annotated in the human wildtype proteome were also excluded.

The best layouts obtained after scrambling 2 million times each of the 4 sublists were then joined to generate an overall layout comprising all 41 neoantigens. Out of all possible combinations of the best 4 layouts the one with the minimal number of predicted epitopes formed by the newly formed junctions was selected.

The whole procedure described was applied two times independently to generate two artificial genes to be encoded alternatively by the GAd20 or MVA vector. For the MVA vector the scrambled layouts were designed with the additional constraint of avoiding the junctions with predicted junctional epitopes that were already present in the layout selected for the Adenoviral transgene.

Amino acid sequences of the optimized layout for the GAd20 is shown in SEQ ID NO: 541 and for MVA SEQ ID NO: 543. Neoantigens in the GAd20 insert of SEQ ID NO: 541 were in the following order: FR1-AS13-AS7-AS6-AS8-P87-FUS3-AS43-AS57-AS51-AS18-AS55-AS23-AS47-MS1-AS37-AS15-AS19-AS11-AS3-P16-P82-FUS5-FUS1-M12-MS6-FU S2-P22-FUS6-MS8-MS3-AS16-M86-M84-M10-FUS8-FUS7-FU S19-AS41-FU S15-P35. Neoantigens in the MVA insert of SEQ DID NO: 543 were in the following order: FR1-AS51-AS6-AS18-AS7-AS43-FUS3-P87-AS8-AS13-AS57-AS55-AS19-AS3-AS23-AS15-AS11-AS37-MS1-AS47-P16-FUS1-FUS6-P22-M12-MS8-FUS5-P82-FUS2-MS3-MS6-AS16-P35-M10-AS41-FUS8-M84-FUS19-FUS15-M86-FUS7

Five additional alternative optimized layouts of scrambled neoantigens were assessed for each vector. The five alternative layouts had the same number of predicted junctional epitopes compared to SEQ ID NO: 541 and SEQ ID NO: 543. The five alternative layouts for Gad20 are shown in SEQ ID NO: 554, SEQ ID NO; 555, SEQ ID NO: 556, SEQ ID NO: 623 and SEQ ID NO: 624. The five alternative layouts for MVA are shown in SEQ ID NO: 557, SEQ ID NO: 558, SEQ ID NO: 559, SEQ ID NO: 625 and SEQ ID NO: 626. The neoantigens in the alternative optimized layouts were in the following order:

SEQ ID NO: 554: FR1-AS13-AS8-P87-FUS3-AS43-AS57-AS51-AS7-AS6-AS18-P16-P82-FUS5-FUS1-M12-MS6-FUS2-P22-FUS6-MS8-MS3-AS55-AS23-AS47-MS1-AS37-AS15-AS19-AS11-AS3-AS16-M86-M84-M10-FUS8-FUS7-FUS19-AS41-FUS15-P35

SEQ ID NO: 555: FR1-AS13-FUS3-P87-AS7-AS43-AS57-AS51-AS6-AS8-AS18-AS55-AS23-AS47-MS1-AS37-AS15-AS19-AS11-AS3-P16-P82-FUS5-FUS1-M12-MS6-FU S2-P22-FUS6-MS8-MS3-AS16-M86-M84-M10-FUS8-FUS7-FU S19-AS41-FUS15-P35

SEQ ID NO: 556: FR1-AS13-AS7-AS43-AS8-P87-FUS3-AS57-AS51-AS6-AS18-AS55-AS23-AS47-MS1-AS37-AS15-AS19-AS11-AS3-P16-P82-FUS5-FUS1-M12-MS6-FU S2-P22-FUS6-MS8-MS3-AS16-M86-M84-M10-FUS8-FUS7-FU S19-AS41-FUS15-P35

SEQ ID NO: 623: P16-P82-FUS5-FUS1-M12-MS6-FUS2-P22-FUS6-MS8-MS3-AS16-M86-M84-M10-FUS8-FUS7-FUS19-AS41-FUS15-P35-AS55-AS23-AS47-MS1-AS37-AS15-AS19-AS11-AS3-FR1-AS13-AS8-P87-FUS3-AS43-AS57-AS51-AS7-AS6-AS18

SEQ ID NO: 624: AS16-M86-M84-M10-FUS8-FUS7-FUS19-AS41-FUS15-P35-P16-P82-FUS5-FUS1-M12-MS6-FUS2-P22-FUS6-MS8-MS3-AS55-AS23-AS47-MS1-AS37-AS15-AS19-AS11-AS3-FR1-AS13-FUS3-P87-AS7-AS43-AS57-AS51-AS6-AS8-AS18

SEQ ID NO: 557: FR1-AS51-AS6-AS18-AS7-AS43-FUS3-P87-AS8-AS13-AS57-AS55-AS37-MS1-AS3-AS23-AS15-AS11-AS19-AS47-P16-FUS1-FUS6-P22-M12-MS8-FUS5-P82-FU S2-MS3-MS6-AS16-P35-M10-AS41-FUS8-M84-FU S19-FU S15-M86-FUS7

SEQ ID NO: 558: AS55-AS19-AS3-AS15-AS23-AS11-AS37-MS1-AS47-FR1-AS51-AS6-AS18-AS7-AS43-FUS3-P87-AS8-AS13-AS57-P16-FUS1-FUS6-P22-M12-MS8-FUS5-P82-FUS2-MS3-MS6-AS16-P35-M10-AS41-FUS8-M84-FUS19-FUS15-M86-FUS7

SEQ ID NO: 559: AS16-P35-M10-AS41-FUS8-M84-FUS19-FUS15-M86-FUS7-AS55-AS19-AS3-AS23-AS15-AS11-AS37-MS1-AS47-P16-FUS1-FUS2-P82-MS8-FUS5-FUS6-P22-M12-MS3-MS6-FR1-AS51-AS6-AS18-AS7-AS43-FUS3-P87-AS8-AS13-AS57

SEQ ID NO: 625: AS16-P35-M10-AS41-FUS8-M84-FUS19-FUS15-M86-FUS7-FR1-AS51-AS6-AS18-AS7-AS43-FUS3-P87-AS8-AS13-AS57-AS55-AS19-AS3-AS15-AS23-AS11-AS37-MS1-AS47-P16-FUS1-FUS6-P22-M12-MS8-FUS5-P82-FUS2-MS3-MS6

SEQ ID NO: 626: AS55-AS11-AS19-AS23-AS3-AS15-AS37-MS1-AS47-FR1-AS51-AS6-AS18-AS7-AS43-FUS3-P87-AS8-AS13-AS57-AS16-P35-M10-AS41-FUS8-M84-FUS19-FUS15-M86-FUS7-P16-FUS1-FUS6-P22-M12-P82-MS8-FUS5-FUS2-MS3-MS6

Insertion of T-Cell Enhancer and TAG Sequences

A small peptide fragment with length of 28aa from the mandarin fish invariant chain (MGQKEQIHTLQKNSERMSKQLTRSSQAV; SEQ ID NO: 549) was placed at the N-terminus of each transgene encoding the 41 neoantigens. Preclinical data has shown this sequence to increase the immunological response of the viral vector. A small segment of 7 amino acids (TAG sequence; seq: SHHHHHH; SEQ ID NO: 627) was added at the C-terminus of the transgene for the purpose of monitoring the expression of the encoded transgene.

Amino acid sequences of the optimized layout for the GAd20 that includes the TCE sequence and omits the tag sequence are shown in SEQ ID NO: 550 and for MVA SEQ ID NO: 551.

Conversion into Nucleotide Sequence and Optimization to Remove Predicted miRNA Binding Sites.

The conversion from amino acid sequence into nucleotide sequence was performed using codon optimizing according to the human codon usage applying additional constraints to avoid as much as possible the following features:

internal TATA-boxes, chi-sites and ribosomal entry sites
AT-rich or GC-rich sequence stretches
RNA instability motifs
repeat sequences and RNA secondary structures
(cryptic) splice donor and acceptor sites in higher eukaryotes
TTTTTnT termination motifs for the MVA vector EcoR1, BamH1 restriction sites and a KOZAK sequence were then added upstream the optimized nucleotide sequence. 2 STOP codons followed by Asc1 and Not1 restriction sites were added downstream the optimized nucleotide sequence.

The optimized nucleotide sequence of each transgene was then further analyzed with the PITA and miranda software to detect predicted miRNA target sites that might downregulate the expression of the synthetic transgene. 9 miRNA binding sites detected by both methods were removed by modifying the nucleotide sequence of the regions that are predicted to bind the miRNA "seed" by introducing synonymous changes in the corresponding codons. The synthesis of GAd20 and MVA transgenes, was performed using standard methods.

The codon optimized polynucleotide sequence encoding the GAd20 neoantigen layout of SEQ ID NO: 541 is shown in SEQ ID NO: 542.

The codon optimized polynucleotide sequence encoding the MVA (neoMVA) neoantigen layout of SEQ ID NO: 543 is shown in SEQ ID NO: 544.

The codon optimized polynucleotide sequence encoding the GAd20 neoantigen layout including the TCE sequence and excluding the TAG sequence of SEQ ID NO: 550 is shown in SEQ ID NO: 551.

The codon optimized polynucleotide sequence encoding the MVA neoantigen layout including the TCE sequence and excluding the TAG sequence of SEQ ID NO: 552 is shown in SEQ ID NO: 553,

```
Kozak sequence:
                                        SEQ ID NO: 545
CGCGACTTCGCCGCC;

Polynucleotide encoding the TCE:
                                        SEQ ID NO: 546
ATGGGCCAGAAAGAGCAGATCCACACACTGCAGAAAAACAGCGAGCGGAT

GAGCAAGCAGCTGACCAGATCTTCTCAGGCCGTG;

Polynucleotide encoding the serine-histidine tag:
                                        SEQ ID NO: 547
AGCCATCACCATCACCACCAT;

Two stop codons
(TAGTAA)

Polypeptide sequence of the TCE:
                                        SEQ ID NO: 549
MGQKEQIHTLQKNSERMSKQLTRSSQAV;
```

GAd20 Viral Vector Production

The GAd20 transgene was subcloned into a shuttle plasmid between CMV promoter with two TetO repeats and a BGH polyA via ECOR1-NOT1 restriction sites.

The resulting expression cassette was transferred into the GAd20 genome by homologous recombination in suitable *E. coli* strains, transformed with the CMV-transgene-BGH DNA fragment and with a construct carrying the GAd20 genome.

Recombination involved CMV and BGH as homology arms, that were already present in the GAd20 construct in place of the E1 deletion (insertion site of the transgene). Recombinant GAd20 vectors were then rescued by transfection of the E1 complementing, TetR expressing M9 cells and amplified by subsequent re-infection of fresh M9 cells.

```
CMV promoter with TetO sites:
                                        SEQ ID NO: 628
Ccattgcatacgttgtatccatatcataatatgtacatttatattggctc

atgtccaacattaccgccatgttgacattgattattgactagttattaat

agtaatcaattacggggtcattagttcatagcccatatatggagttccgc

gttacataacttacggtaaatggcccgcctggctgaccgcccaacgaccc

ccgcccattgacgtcaataatgacgtatgttcccatagtaacgccaatag

ggactttccattgacgtcaatgggtggagtatttacggtaaactgcccac

ttggcagtacatcaagtgtatcatatgccaagtacgccccctattgacgt

caatgacggtaaatggcccgcctggcattatgcccagtacatgaccttat

gggactttcctacttggcagtacatctacgtattagtcatcgctattacc

atggtgatgcggttttggcagtacatcaatgggcgtggatagcggtttga

ctcacggggatttccaagtctccaccccattgacgtcaatgggagtttgt

tttggcaccaaaatcaacgggactttccaaaatgtcgtaacaactccgcc

ccattgacgcaaatgggcggtaggcgtgtacggtgggaggtctatataag

cagagctctccctatcagtgatagagatctccctatcagtgatagagatc

gtcgacgagctcgtttagtgaaccgtcagatcgcctggagacgccatcca

cgctgttttgacctccatagaagacaccgggaccgatccagcctccgcgg

ccgggaacggtgcattggaacgcggattccccgtgccaagagtga

BGH polyA
                                        SEQ ID NO: 629
ctgtgccttctagttgccagccatctgttgtttgcccctcccccgtgcct

tccttgaccctggaaggtgccactcccactgtcctttcctaataaaatga

ggaaattgcatcgcattgtctgagtaggtgtcattctattctggggggtg

gggtggggcaggacagcaagggggaggattgggaagacaatagcaggcat

gctggggatgcggtgggctctatggcc
```

MVA Viral Vector Production

The MVA transgene was subcloned into the p94 shuttle plasmid via BAMH1-ASC1 restriction sites, under the control of the vaccinia P7.5 early/late promoter (SEQ ID NO: 630), between sequences homologous to the deletion III locus of MVA (FlankIII-1 and -2 regions). An additional expression cassette for eGFP protein, flanked by a repeated sequence named "Z", was present in the p94 shuttle plasmid, between Flank III regions.

The parental MVA vector used for recombinant vaccine viruses' generation carried the HcRed1-1 fluorescent protein transgene at the Deletion III locus and was indicated as MVA-RED 476 MG.

Recombinant MVA, with transgene insertion at the Deletion III locus, were generated by two events of in vivo recombination in Chicken embryo fibroblasts (CEF) cells. The first recombination event occurred in cells infected with MVA-RED 476 MG and transfected with the p94 shuttle plasmid, and resulted in replacement of the HcRed protein gene with the transgene/eGFP cassette. Infected cells containing MVA-Green intermediate were isolated by FACS sorting of green cells. The intermediate recombinant MVA resulting from first recombination carried both the transgene and the eGFP cassette but was unstable due to the presence of repeated Z regions. Thus, a spontaneous second recombination event occurred involving Z regions and removed the eGFP cassette. The resulting recombinant MVA was colorless and carried the transgene cassette at the Deletion III locus (insertion site) of MVA-RED 476 MG. This was isolated by FACS sorting of colorless infected cells and amplified by re-infection of fresh CEF cells. The obtained lysate was used to infect Age1 cells to produce the research batch.

P7.5 early/late promoter

SEQ ID NO: 630

GATCACTAATTCCAAACCCACCCGCTTTTTATAGTAAGTTTTTCACCCATAAATAATAAATACAATAATTA

ATTTCTCGTAAAAGTAGAAAATATATTCTAATTTATTGCACGGTAAGGAAGTAGAATCATAAAGAACAGTG

ACGGATC neoGAd20 protein (no TCE, no HIS tag)

SEQ ID NO: 541

QNLQNGGGSRSSATLPGRRRRRWLRRRRQPISVAPAGPPRRPNQKPNPPGGARCVIMRPTWPGTSAFTKRS

FAVTERIIDYWAQKEKGSSSFLRPSCDYWAQKEKISIPRTHLCLVLGVLSGHSGSRLYEAGMTLGGKILFF

LFLLLPLSPFSLIFTEISCCTLSSEENEYLPRPEWQLQVPFRELKNVSVLEGLRQGRLGGPCSCHCPRPSQ

ARLTPVDVAGPFLCLGDPGLFPPVKSSITGGKSTCSAPGPQSLPSTPFSTYPQWVILITELGMECTLGQVG

APSPRREEDGWRGGHSRFKADVPAPQGPCWGGQPGSAPSSAPPEQSLLDWKFEMSYTVGGPPPHVHARPRH

WKTDRDGHSYTSKVNCLLLQDGFHGCVSITGAAGRRNLSIFLFLMLCKLEFHACKIQNKNCPDFKKFDGPC

GERGGGRTARALWARGDSVLTPALDPQTPVRAPSLTRAAAAVHYKLIQQPISLFSITDRLHKTFSQLPSVH

LCSITFQWGHPPIFCSTNDICVTANFCISVTFLKPCFLLHEASASQCHLFLQPQVGTPPPHTASARAPSGP

PHPHESCPAGRRPARAAQTCARRQHGLPGCEEAGTARVPSLHLHLHQAALGAGRGRGWGEACAQVPPSRGV

LRFLDLKVRYLHSQWQHYHRSGEAAGTPLWRPTRNVPFRELKNQRTAQGAPGIHHAASPVAANLCDPARHA

QHTRIPCGAGQVRAGRGPEAGGGVLQPQRPAPEKPGCPCRRGQPRLHTVKMWRAVAMMVPDRQVHYDFGLG

VPGDSTRRAVRRMNTFYEAGMTLGEKFRVGNCKHLKMTRPNSKMALNSEALSVVSECGASACDVSLIAMDS

AFVQGKDWGVKKFIRRDFYAYKDFLWCFPFSLVFLQEIQICCHVSCLCCICCSTRICLGCLLELFLSRALR

ALHVLWNGFQLHCQTEYNQKLQVNQFSESKSLYHREKQLIAMDSAICEERGAAGSLISCETMPAILKLQKN

CLLSLRTALTHNQDFSIYRLCCKRGSLCHASQARSPAFPKPVRPLPAPITRITPQLGGQSDSSQPLLTTGR

PQGWQDQALRHTQQASPASCATITIPIHSAALGDHSGDPGPAWDTCPPLPLTTLIPRAPPPYGDSTARSWP

SRCGPLGGNTTLQQLGEASQAPSGSLIPLRLPLLWEVRGQPDSFAALHSSLNELGEIARELHQFAFDLLIK

SHFVQGKDWGLKKFIRRDFWGMELAASRRFSWDHHSAGGPPRVPSVRSGAAQVQPKDPLPLRTLAGCLART

AHLRPGAESLPQPQLHCTLWFQSSELSPTGAPWPSRRPTWRGTTVSPRTATSSARTCCGTKWPSSQEAALG

LGSGLLRFSCGTAAIRKMHFSLKEHPPPPCPPEAFQRAAGEGGPGRGGARRGARVLQSPFCRAGAGEWLGH

QSLRHVVGYGHLDTSGSSSSSSSWPNSKMALNSLNSIDDAQLTRIAPPRSHCCFWEVNAP neoGAd20 polynucleotide (no TCE, no HIS tag)

SEQ ID NO: 542

CAGAACCTGCAGAACGGCGGAGGCTCTAGAAGCTCTGCTACACTTCCTGGCAGGCGGCGGAGAAGATGGCT

GAGAAGAAGGCGGCAGCCTATCTCTGTGGCTCCTGCTGGACCTCCTAGACGGCCCAACCAGAAGCCTAATC

CTCCTGGCGGAGCCAGATGCGTGATCATGAGGCCTACATGGCCTGGCACCAGCGCCTTCACCAAGAGAAGC

TTTGCCGTGACCGAGCGGATCATCGACTATTGGGCTCAAAAAGAGAAGGGCAGCAGCAGCTTCCTGCGGCC

TAGCTGTGATTATTGGGCCCAGAAAGAAAAGATCAGCATCCCCAGAACACACCTGTGCCTGGTGCTGGGAG

TGCTGTCTGGACACTCTGGCAGCAGACTGTATGAGGCCGGCATGACACTCGGCGGCAAGATCCTGTTCTTC

CTGTTCCTGCTGCTCCCTCTGAGCCCCTTCAGCCTGATCTTCACCGAGATCAGCTGCTGCACCCTGAGCAG

-continued

CGAGGAAAACGAGTACCTGCCTAGACCTGAGTGGCAGCTGCAGGTCCCCTTCAGAGAGCTGAAGAACGTTT

CCGTGCTGGAAGGCCTGAGACAGGGCAGACTTGGCGGCCCTTGTAGCTGTCACTGCCCCAGACCTAGTCAG

GCCAGACTGACACCTGTGGATGTGGCCGGACCTTTCCTGTGTCTGGGAGATCCTGGCCTGTTTCCACCTGT

GAAGTCCAGCATCACAGGCGGCAAGTCCACATGTTCTGCCCCTGGACCTCAGAGCCTGCCTAGCACACCCT

TCAGCACATACCCTCAGTGGGTCATCCTGATCACCGAACTCGGCATGGAATGCACCCTGGGACAAGTGGGA

GCCCCATCTCCTAGAAGAGAAGAGGATGGCTGGCGCGGAGGCCACTCTAGATTCAAAGCTGATGTGCCCGC

TCCTCAGGGCCCTTGTTGGGGAGGACAACCTGGATCTGCCCCATCTTCTGCCCCACCTGAACAGTCCCTGC

TGGATTGGAAGTTCGAGATGAGCTACACCGTCGGCGGACCTCCACCTCATGTTCATGCCAGACCTCGGCAC

TGGAAAACCGACAGAGATGGCCACAGCTACACCAGCAAAGTGAACTGCCTCCTGCTGCAGGATGGCTTCCA

CGGCTGTGTGTCTATTACTGGCGCCGCTGGCAGACGGAACCTGAGCATCTTTCTGTTTCTGATGCTGTGCA

AGCTCGAGTTCCACGCCTGCAAGATCCAGAACAAGAACTGCCCCGACTTCAAGAAGTTCGACGGCCCTTGC

GGAGAAAGAGGCGGAGGCAGAACAGCTAGAGCCCTTTGGGCTAGAGGCGACAGCGTTCTGACACCAGCTCT

GGACCCTCAGACACCTGTTAGGGCCCCTAGCCTGACAAGAGCTGCCGCCGCTGTGCACTACAAGCTGATCC

AGCAGCCAATCAGCCTGTTCAGCATCACCGACCGGCTGCACAAGACATTCAGCCAGCTGCCAAGCGTGCAC

CTGTGCTCCATCACCTTCCAGTGGGGACACCCTCCTATCTTTTGCTCCACCAACGACATCTGCGTGACCGC

CAACTTCTGTATCAGCGTGACCTTCCTGAAGCCTTGCTTTCTGCTGCACGAGGCCAGCGCCTCTCAGTGCC

ACTTGTTTCTGCAGCCCCAAGTGGGCACACCTCCTCCACATACAGCCTCTGCTAGAGCACCTAGCGGCCCT

CCACATCCTCACGAATCTTGTCCTGCCGGAAGAAGGCCTGCCAGAGCCGCTCAAACATGTGCCAGACGACA

GCACGGACTGCCTGGATGTGAAGAGGCTGGAACAGCCAGAGTGCCTAGCCTGCACCTCCATCTGCATCAGG

CTGCTCTTGGAGCCGGAAGAGGTAGAGGATGGGGCGAAGCTTGTGCTCAGGTGCCACCTTCTAGAGGCGTG

CTGAGATTCCTGGACCTGAAAGTGCGCTACCTGCACAGCCAGTGGCAGCACTATCACAGATCTGGCGAAGC

CGCCGGAACACCCCTTTGGAGGCCAACAAGAAACGTGCCCTTCCGGGAACTGAAGAACCAGAGAACAGCTC

AGGGCGCTCCTGGAATCCACCATGCTGCTTCTCCAGTGGCCGCCAACCTGTGTGATCCTGCCAGACATGCC

CAGCACACCAGGATTCCTTGTGGCGCTGGACAAGTGCGCGCTGGAAGAGGACCTGAAGCAGGCGGAGGTGT

TCTGCAACCTCAAAGACCCGCTCCTGAGAAGCCTGGCTGCCCTTGCAGAAGAGGACAGCCTAGACTGCACA

CCGTGAAAATGTGGCGAGCCGTGGCCATGATGGTGCCCGATAGACAGGTCCACTACGACTTTGGACTGGGC

GTGCCAGGCGATAGCACTCGGAGAGCCGTCAGACGGATGAACACCTTTTACGAAGCCGGGATGACCCTGGG

CGAGAAGTTCAGAGTGGGCAACTGCAAGCACCTGAAGATGACCCGGCCTAACAGCAAGATGGCCCTGAATA

GCGAGGCCCTGTCTGTGGTGTCTGAATGTGGCGCCTCTGCCTGTGACGTGTCCCTGATCGCTATGGACTCC

GCCTTTGTGCAGGGCAAAGACTGGGGCGTGAAGAAGTTCATCCGGCGGGACTTCTACGCCTACAAGGACTT

CCTGTGGTGCTTCCCCTTCTCTCTGGTGTTCCTGCAAGAGATCCAGATCTGCTGTCATGTGTCCTGCCTGT

GCTGCATCTGCTGTAGCACCAGAATCTGCCTGGGCTGTCTGCTGGAACTGTTCCTGAGCAGAGCCCTGAGA

GCACTGCACGTGCTGTGGAACGGATTCCAGCTGCACTGCCAGACCGAGTACAACCAGAAACTGCAAGTGAA

CCAGTTCAGCGAGAGCAAGAGCCTGTACCACCGGGAAAAGCAGCTCATTGCCATGGACAGCGCCATCTGCG

AAGAGAGAGGCGCCGCAGGATCTCTGATCTCCTGCGAAACAATGCCCGCCATCCTGAAGCTGCAGAAGAAT

TGCCTCCTAAGCCTGCGAACCGCTCTGACACACAACCAGGACTTCAGCATCTACAGACTGTGTTGCAAGCG

GGGCTCCCTGTGCCATGCAAGCCAAGCTAGAAGCCCCGCCTTTCCTAAACCTGTGCGACCTCTGCCAGCTC

CAATCACCAGAATTACCCCTCAGCTCGGCGGCCAGAGCGATTCATCTCAACCTCTGCTGACCACCGGCAGA

CCTCAAGGCTGGCAAGACCAAGCTCTGAGACACACCCAGCAGGCTAGCCCTGCCTCTTGTGCCACCATCAC

AATCCCCATCCACTCTGCCGCTCTGGGCGATCATTCTGGCGATCCTGGACCAGCCTGGGACACATGTCCTC

CACTGCCACTCACAACACTGATCCCTAGGGCTCCTCCACCTTACGGCGATTCTACCGCTAGAAGCTGGCCC

-continued

AGCAGATGTGGACCACTCGGAGGCAACACAACCCTCCAGCAACTGGGAGAAGCCTCTCAGGCTCCTAGCGG

CTCTCTGATCCCTCTCAGACTGCCTCTCCTGTGGGAAGTTCGGGGCCAGCCTGATTCTTTTGCCGCACTGC

ACAGCTCCCTGAACGAGCTGGGAGAGATCGCTAGAGAGCTGCACCAGTTCGCCTTCGACCTGCTGATCAAG

AGCCACTTCGTGCAAGGCAAGGATTGGGGCCTCAAAAAGTTTATCCGCAGAGACTTCTGGGGCATGGAACT

GGCCGCCAGCAGAAGATTCAGCTGGGATCATCATAGCGCAGGCGGCCCACCTAGAGTGCCATCTGTTAGAA

GCGGAGCTGCCCAGGTGCAGCCTAAAGATCCTCTGCCACTGAGAACACTGGCCGGCTGCCTTGCTAGAACA

GCCCATCTTAGACCTGGCGCCGAGTCTCTGCCTCAGCCACAACTGCACTGTACCCTGTGGTTCCAGTCCAG

CGAGCTGTCTCCTACTGGTGCCCCTTGGCCATCTAGACGCCCTACTTGGAGAGGCACCACCGTGTCACCAA

GAACCGCCACAAGCAGCGCCAGAACCTGTTGTGGCACAAAGTGGCCCTCCAGCCAAGAAGCCGCTCTCGGA

CTTGGAAGCGGACTGCTGAGGTTCTCTTGTGGAACCGCCGCCATTCGGAAGATGCACTTTAGCCTGAAAGA

ACACCCTCCACCACCTTGTCCTCCAGAGGCTTTCCAAAGAGCTGCTGGCGAAGGCGGACCTGGTAGAGGTG

GTGCTAGAAGAGGTGCTAGGGTGCTGCAGAGCCCATTCTGTAGAGCAGGCGCAGGCGAATGGCTGGGCCAT

CAGAGTCTGAGACATGTCGTCGGCTACGGCCACCTGGATACAAGCGGAAGCAGCTCTAGCTCCAGCTGGCC

TAACTCAAAAATGGCTCTGAACAGCCTGAACTCCATCGACGACGCCCAGCTGACAAGAATCGCCCCTCCTA

GATCTCACTGCTGCTTTTGGGAAGTGAACGCCCCA neoMVA protein (no TCE, no HIS Tag)

SEQ ID NO: 543

QNLQNGGGSRSSATLPGRRRRRWLRRRRQPISVAPAGPPRRPNQKPNPPGGARCVIMRPTWPGTS

AFTGMECTLGQVGAPSPRREEDGWRGGHSRFKADVPAPQGPCWGGQPGSAPSSAPPEQSLLDDYWAQKEKI

SIPRTHLCWKFEMSYTVGGPPPHVHARPRHWKTDRDYWAQKEKGSSSFLRPSCVPFRELKNVSVLEGLRQG

RLGGPCSCHCPRPSQARLTPVDVAGPFLCLGDPGLFPPVKSSITEISCCTLSSEENEYLPRPEWQLQYEAG

MTLGGKILFFLFLLLPLSPFSLIFLVLGVLSGHSGSRLKRSFAVTERIITGGKSTCSAPGPQSLPSTPFST

YPQWVILITELDGHSYTSKVNCLLLQDGFHGCVSITGAAGRRNLSIFLFLMLCKLEFHACQWQHYHRSGEA

AGTPLWRPTRNVAMMVPDRQVHYDFGLKIQNKNCPDVLRFLDLKVRYLHSVPFRELKNQRTAQGAPGIHHA

ASPVAANLCDPARHAQHTRIPCGAGQVRAGRGPEAGGGVLQPQRPAPEKPGCPCRRGQPRLHTVKMWRACH

LFLQPQVGTPPPHTASARAPSGPPHPHESCPAGRRPARAAQTCARRQHGLPGCEEAGTARVPSLHLHLHQA

ALGAGRGRGWGEACAQVPPSRGHYKLIQQPISLFSITDRLHKTFSQLPSVHLCSITFQWGHPPIFCSTNDI

CVTANFCISVTFLKPCFLLHEASASQFKKFDGPCGERGGGRTARALWARGDSVLTPALDPQTPVRAPSLTR

AAAAVGVPGDSTRRAVRRMNTFCGASACDVSLIAMDSACEERGAAGSLISCESLYHREKQLIAMDSAIFVQ

GKDWGVKKFIRRDFTMPAILKLQKNCLLSLNSKMALNSEALSVVSEYEAGMTLGEKFRVGNCKHLKMTRPT

EYNQKLQVNQFSESKRTALTHNQDFSIYRLCCKRGSLCHASQARSPAFPKPVRPLPAPITRITPQLGGQSD

SSQPLLTTGRPQGWQDQALRHTQQASPASCATITIPIHSAALGDHSGDPGPAWDTCPPLPLTTLIPRAPPP

YGDSTARSWPSRCGPLGYAYKDFLWCFPFSLVFLQEIQICCHVSCLCCICCSTRICLGCLLELFLSRALRA

LHVLWNGFQLHCQGNTTLQQLGEASQAPSGSLIPLRLPLLWEVRGNSKMALNSLNSIDDAQLTRIAPPRSH

CCFWEVNAPFVQGKDWGLKKFIRRDFEAFQRAAGEGGPGRGGARRGARVLQSPFCRAGAGEWLGHQSLRWG

MELAASRRFSWDHHSAGGPPRVPSVRSGAAQVQPKDPLPLRTLAGCLARTAHLRPGAESLPQPQLHCTIAR

ELHQFAFDLLIKSHKMHFSLKEHPPPPCPPHVVGYGHLDTSGSSSSSSWPQPDSFAALHSSLNELGELWFQ

SSELSPTGAPWPSRRPTWRGTTVSPRTATSSARTCCGTKWPSSQEAALGLGSGLLRFSCGTAAIR neoMVA polynucleotide

SEQ ID NO: 544

CAGAACCTGCAGAACGGCGGAGGCTCTAGAAGCTCTGCTACACTTCCTGGCAGGCGGCGGAGAAG

ATGGCTGAGAAGAAGGCGGCAGCCTATCTCTGTGGCTCCTGCTGGACCTCCTAGACGGCCCAACCAGAAGC

-continued

CTAATCCTCCTGGCGGAGCCAGATGCGTGATCATGAGGCCTACATGGCCTGGCACCAGCGCCTTTACCGGC

ATGGAATGTACACTGGGCCAAGTGGGAGCCCCATCTCCTAGAAGAGAAGAGGATGGCTGGCGCGGAGGCCA

CTCTAGATTCAAAGCTGATGTGCCCGCTCCTCAGGGCCCTTGTTGGGGAGGACAACCTGGATCTGCCCCAT

CTTCTGCCCCACCTGAACAGAGCCTGCTGGATGACTATTGGGCTCAAAAAGAGAAGATCAGCATCCCCAGA

ACACACCTGTGCTGGAAGTTCGAGATGAGCTACACCGTTGGCGGCCCTCCACCACATGTTCACGCCAGACC

TAGACACTGGAAAACCGACAGAGATTATTGGGCCCAGAAAGAAAAGGGCAGCAGCAGCTTCCTGCGGCCTA

GCTGTGTGCCCTTCCGGGAACTGAAGAACGTGTCCGTTCTGGAAGGCCTGAGGCAGGGCAGACTTGGCGGA

CCTTGTAGCTGCCACTGTCCTAGACCAAGCCAGGCCAGACTGACCCCTGTGGATGTGGCTGGCCCATTTCT

GTGTCTGGGCGACCCTGGACTGTTCCCTCCAGTGAAGTCTAGCATCACCGAGATCAGCTGCTGCACCCTGA

GCAGCGAGGAAAACGAGTACCTGCCTAGACCTGAATGGCAGCTGCAGTACGAGGCCGGCATGACACTCGGA

GGCAAGATCCTGTTCTTCCTGTTCCTGCTGCTCCCTCTGAGCCCCTTCAGCCTGATCTTTCTGGTGCTGGG

CGTGCTGTCTGGCCACTCTGGAAGCAGACTGAAGAGAAGCTTCGCCGTGACCGAGCGGATCATCACAGGCG

GCAAGAGCACATGTTCTGCCCCTGGACCTCAGTCTCTGCCCAGCACACCCTTCAGCACATACCCTCAGTGG

GTCATCCTGATCACCGAGCTGGATGGCCACAGCTACACCAGCAAAGTGAACTGCCTCCTGCTGCAGGATGG

CTTCCACGGCTGTGTGTCTATTACTGGCGCCGCTGGCAGACGGAACCTGAGCATCTTTCTGTTTCTGATGC

TGTGCAAGCTCGAGTTCCACGCCTGCCAATGGCAGCACTACCACAGATCTGGCGAAGCCGCTGGAACCCCA

CTTTGGAGGCCTACCAGAAACGTGGCCATGATGGTGCCCGACAGACAGGTGCACTACGACTTCGGCCTGAA

GATCCAGAACAAGAACTGCCCCGACGTGCTGCGGTTCCTGGATCTCAAAGTGCGCTACCTGCACAGCGTGC

CCTTCAGAGAGCTGAAAAACCAGAGAACAGCCCAGGGCGCTCCTGGAATCCATCATGCTGCTTCTCCAGTG

GCCGCCAATCTGTGCGATCCTGCCAGACATGCCCAGCATACCAGGATTCCTTGTGGCGCTGGACAAGTGCG

CGCTGGAAGAGGACCTGAAGCTGGTGGCGGAGTTCTGCAGCCTCAAAGACCTGCTCCTGAGAAGCCTGGCT

GCCCCTGTAGAAGAGGACAGCCTAGACTGCACACCGTGAAGATGTGGCGGGCCTGCCACTTGTTTCTCCAG

CCACAAGTGGGCACCCCTCCACCTCATACAGCCTCTGCTAGAGCACCTAGCGGCCCACCTCATCCTCACGA

ATCTTGTCCTGCCGGAAGAAGGCCTGCCAGAGCCGCTCAAACATGTGCCAGACGACAGCACGGACTGCCCG

GATGTGAAGAAGCCGGAACAGCCAGAGTGCCTAGCCTGCACCTTCATCTGCATCAGGCCGCTCTTGGAGCC

GGAAGAGGTAGAGGATGGGGAGAAGCTTGTGCCCAGGTGCCACCTTCTAGAGGCCACTACAAGCTGATCCA

GCAGCCAATCAGCCTGTTCTCCATCACCGACCGGCTGCACAAGACATTCAGCCAGCTGCCTTCCGTGCATC

TGTGCAGCATCACCTTCCAGTGGGGACACCCTCCTATCTTTTGCTCCACCAACGACATCTGCGTGACCGCC

AACTTCTGTATCAGCGTGACCTTCCTGAAGCCTTGCTTTCTGCTGCACGAGGCCTCCGCCAGCCAGTTTAA

GAAGTTTGACGGCCCCTGCGGCGAGAGAGGCGGAGGAAGAACTGCAAGAGCCCTTTGGGCCAGAGGCGACT

CTGTTCTGACACCAGCTCTGGACCCTCAGACACCTGTTAGGGCCCCTAGCCTGACAAGAGCTGCCGCTGCT

GTTGGAGTGCCTGGCGATTCTACTAGAAGGGCCGTGCGGCGGATGAACACCTTTTGTGGCGCATCTGCCTG

CGACGTGTCCCTGATCGCTATGGATAGCGCCTGCGAGGAAAGAGGCGCAGCCGGATCTCTGATCTCTTGCG

AGAGCCTGTACCACCGGGAAAAGCAGCTCATTGCCATGGACAGCGCCATCTTCGTGCAGGGCAAAGACTGG

GGCGTGAAGAAGTTCATCCGGCGGGACTTTACCATGCCTGCCATTCTGAAGCTGCAGAAGAATTGTCTTCT

AAGCCTGAACAGCAAGATGGCCCTGAATAGCGAGGCCCTGTCTGTGGTGTCCGAGTATGAGGCTGGAATGA

CCCTGGGCGAGAAGTTCAGAGTGGGCAACTGCAAGCACCTGAAGATGACCCGGCCTACCGAGTACAACCAG

AAACTGCAAGTGAACCAGTTCAGCGAGAGCAAGCGGACCGCTCTGACCCACAACCAGGACTTCAGCATCTA

CCGGCTGTGCTGCAAGAGGGGCTCTCTGTGTCATGCTAGCCAGGCTAGAAGCCCCGCCTTTCCTAAGCCTG

TCAGACCTCTGCCTGCTCCTATCACCAGAATCACCCCTCAGCTCGGCGGCCAGTCTGATTCATCTCAGCCA

CTGCTGACCACCGGCAGACCTCAAGGATGGCAAGACCAGGCTCTGAGACACACACAGCAGGCTAGCCCAGC

-continued

CTCTTGCGCCACCATCACAATACCAATACATTCTGCCGCTCTGGGCGATCACAGCGGAGATCCTGGACCTG

CCTGGGATACTTGTCCTCCTCTGCCCCTAACTACACTGATCCCTAGGGCTCCTCCACCTTACGGCGATAGC

ACAGCCAGATCCTGGCCTAGCAGATGTGGCCCTCTGGGCTACGCCTACAAGGACTTCCTGTGGTGCTTCCC

CTTCTCTCTGGTGTTCCTGCAAGAAATCCAGATCTGCTGTCACGTGTCCTGCCTGTGCTGTATCTGCTGTA

GCACCCGGATCTGTCTGGGCTGTCTGCTGGAACTGTTCCTGAGCAGAGCCCTGAGAGCACTGCACGTGCTG

TGGAACGGATTCCAGCTGCACTGCCAGGGCAACACCACACTGCAACAGCTGGGAGAAGCCTCTCAGGCCCC

AAGCGGTTCTCTGATCCCTCTCAGACTGCCCCTCCTGTGGGAAGTGCGGGGCAATTCTAAGATGGCTCTCA

ACAGCCTGAACTCCATCGACGACGCCCAGCTGACAAGAATCGCCCCTCCAAGAAGCCACTGTTGCTTTTGG

GAAGTGAACGCCCCTTTTGTGCAGGGTAAAGATTGGGGCCTCAAAAAGTTTATCAGACGGGACTTCGAGGC

TTTCCAGAGAGCAGCTGGCGAAGGCGGACCTGGCAGAGGTGGTGCTAGAAGAGGTGCTAGAGTGCTGCAGA

GCCCATTCTGTAGAGCTGGCGCTGGCGAATGGCTGGGCCACCAATCTCTTAGATGGGGAATGGAACTGGCC

GCTAGCAGGCGGTTTAGCTGGGATCATCATTCTGCCGGCGGACCTCCAAGAGTGCCAAGCGTTAGAAGCGG

AGCAGCCCAGGTCCAGCCTAAAGATCCACTGCCACTGAGAACACTGGCCGGCTGCCTTGCCAGAACAGCTC

ATCTTAGACCTGGCGCCGAAAGCCTGCCTCAACCTCAGCTGCATTGCACAATCGCCAGAGAACTGCACCAG

TTCGCCTTCGACCTGCTGATCAAGAGCCACAAGATGCACTTCTCACTGAAAGAGCACCCGCCACCGCCGTG

CCCACCGCACGTTGTCGGCTATGGCCACCTGGATACAAGCGGCTCCTCTAGCAGTAGCTCCTGGCCTCAGC

CTGACAGCTTTGCTGCCCTGCATAGCTCCCTGAATGAGCTGGGCGAACTGTGGTTCCAGTCCAGCGAACTG

TCTCCTACTGGCGCTCCATGGCCAAGCAGAAGGCCTACTTGGAGAGGCACCACCGTGTCTCCAAGAACCGC

TACAAGCAGCGCCAGAACCTGTTGCGGCACAAAATGGCCCTCCAGCCAAGAAGCTGCCCTCGGACTTGGAA

GCGGACTGCTGAGATTCAGCTGTGGCACAGCCGCCATCAGA neoGAd20 expression cassette protein

SEQ ID NO: 550

MGQKEQIHTLQKNSERMSKQLTRSSQAVQNLQNGGGSRSSATLPGRRRRRWLRRRRQPISVAPAG

PPRRPNQKPNPPGGARCVIMRPTWPGTSAFTKRSFAVTERIIDYWAQKEKGSSSFLRPSCDYWAQKEKISI

PRTHLCLVLGVLSGHSGSRLYEAGMTLGGKILFFLFLLLPLSPFSLIFTEISCCTLSSEENEYLPRPEWQL

QVPFRELKNVSVLEGLRQGRLGGPCSCHCPRPSQARLTPVDVAGPFLCLGDPGLFPPVKSSITGGKSTCSA

PGPQSLPSTPFSTYPQWVILITELGMECTLGQVGAPSPRREEDGWRGGHSRFKADVPAPQGPCWGGQPGSA

PSSAPPEQSLLDWKFEMSYTVGGPPPHVHARPRHWKTDRDGHSYTSKVNCLLLQDGFHGCVSITGAAGRRN

LSIFLFLMLCKLEFHACKIQNKNCPDFKKFDGPCGERGGGRTARALWARGDSVLTPALDPQTPVRAPSLTR

AAAAVHYKLIQQPISLFSITDRLHKTFSQLPSVHLCSITFQWGHPPIFCSTNDICVTANFCISVTFLKPCF

LLHEASASQCHLFLQPQVGTPPPHTASARAPSGPPHPHESCPAGRRPARAAQTCARRQHGLPGCEEAGTAR

VPSLHLHLHQAALGAGRGRGWGEACAQVPPSRGVLRFLDLKVRYLHSQWQHYHRSGEAAGTPLWRPTRNVP

FRELKNQRTAQGAPGIHHAASPVAANLCDPARHAQHTRIPCGAGQVRAGRGPEAGGGVLQPQRPAPEKPGC

PCRRGQPRLHTVKMWRAVAMMVPDRQVHYDFGLGVPGDSTRRAVRRMNTFYEAGMTLGEKFRVGNCKHLKM

TRPNSKMALNSEALSVVSECGASACDVSLIAMDSAFVQGKDWGVKKFIRRDFYAYKDFLWCFPFSLVFLQE

IQICCHVSCLCCICCSTRICLGCLLELFLSRALRALHVLWNGFQLHCQTEYNQKLQVNQFSESKSLYHREK

QLIAMDSAICEERGAAGSLISCETMPAILKLQKNCLLSLRTALTHNQDFSIYRLCCKRGSLCHASQARSPA

FPKPVRPLPAPITRITPQLGGQSDSSQPLLTTGRPQGWQDQALRHTQQASPASCATITIPIHSAALGDHSG

DPGPAWDTCPPLPLTTLIPRAPPPYGDSTARSWPSRCGPLGGNTTLQQLGEASQAPSGSLIPLRLPLLWEV

RGQPDSFAALHSSLNELGEIARELHQFAFDLLIKSHFVQGKDWGLKKFIRRDFWGMELAASRRFSWDHHSA

GGPPRVPSVRSGAAQVQPKDPLPLRTLAGCLARTAHLRPGAESLPQPQLHCTLWFQSSELSPTGAPWPSRR

-continued

PTWRGTTVSPRTATSSARTCCGTKWPSSQEAALGLGSGLLRFSCGTAAIRKMHFSLKEHPPPPCPPEAFQR

AAGEGGPGRGGARRGARVLQSPFCRAGAGEWLGHQSLRHVVGYGHLDTSGSSSSSSWPNSKMALNSLNSID

DAQLTRIAPPRSHCCFWEVNAP neoGAd20 expression cassette polynucleotide

SEQ ID NO: 551

Ccattgcatacgttgtatccatatcataatatgtacatttatattggctcatgtccaacattacc gccatgttgacattgattattgactagttattaatagtaatcaattacggggtcattagttcatagcccat atatggagttccgcgttacataacttacggtaaatggcccgcctggctgaccgcccaacgacccccgccca ttgacgtcaataatgacgtatgttcccatagtaacgccaatagggactttccattgacgtcaatgggtgga gtatttacggtaaactgcccacttggcagtacatcaagtgtatcatatgccaagtacgccccctattgacg tcaatgacggtaaatggcccgcctggcattatgcccagtacatgaccttatgggactttcctacttggcag tacatctacgtattagtcatcgctattaccatggtgatgcggttttggcagtacatcaatgggcgtggata gcggtttgactcacggggatttccaagtctccaccccattgacgtcaatgggagtttgttttggcaccaaa atcaacgggactttccaaaatgtcgtaacaactccgccccattgacgcaaatgggcggtaggcgtgtacgg tgggaggtctatataagcagagctctccctatcagtgatagagatctccctatcagtgatagagatcgtcg acgagctcgtttagtgaaccgtcagatcgcctggagacgccatccacgctgttttgacctccatagaagac accgggaccgatccagcctccgcggccgggaacggtgcattggaacgcggattccccgtgccaagagtgag atcttccgtttatctaggtaccagatatcaGAATTCGGATCCCGCGACTTCGCCGCCATGGGCCAGAAAGA

GCAGATCCACACACTGCAGAAAAACAGCGAGCGGATGAGCAAGCAGCTGACCAGATCTTCTCAGGCCGTGC

AGAACCTGCAGAACGGCGGAGGCTCTAGAAGCTCTGCTACACTTCCTGGCAGGCGGCGGAGAAGATGGCTG

AGAAGAAGGCGGCAGCCTATCTCTGTGGCTCCTGCTGGACCTCCTAGACGGCCCAACCAGAAGCCTAATCC

TCCTGGCGGAGCCAGATGCGTGATCATGAGGCCTACATGGCCTGGCACCAGCGCCTTCACCAAGAGAAGCT

TTGCCGTGACCGAGCGGATCATCGACTATTGGGCTCAAAAAGAGAAGGGCAGCAGCAGCTTCCTGCGGCCT

AGCTGTGATTATTGGGCCCAGAAAGAAAAGATCAGCATCCCCAGAACACACCTGTGCCTGGTGCTGGGAGT

GCTGTCTGGACACTCTGGCAGCAGACTGTATGAGGCCGGCATGACACTCGGCGGCAAGATCCTGTTCTTCC

TGTTCCTGCTGCTCCCTCTGAGCCCCTTCAGCCTGATCTTCACCGAGATCAGCTGCTGCACCCTGAGCAGC

GAGGAAAACGAGTACCTGCCTAGACCTGAGTGGCAGCTGCAGGTCCCCTTCAGAGAGCTGAAGAACGTTTC

CGTGCTGGAAGGCCTGAGACAGGGCAGACTTGGCGGCCCTTGTAGCTGTCACTGCCCCAGACCTAGTCAGG

CCAGACTGACACCTGTGGATGTGGCCGGACCTTTCCTGTGTCTGGGAGATCCTGGCCTGTTTCCACCTGTG

AAGTCCAGCATCACAGGCGGCAAGTCCACATGTTCTGCCCCTGGACCTCAGAGCCTGCCTAGCACACCCTT

CAGCACATACCCTCAGTGGGTCATCCTGATCACCGAACTCGGCATGGAATGCACCCTGGGACAAGTGGGAG

CCCCATCTCCTAGAAGAGAAGAGGATGGCTGGCGCGGAGGCCACTCTAGATTCAAAGCTGATGTGCCCGCT

CCTCAGGGCCCTTGTTGGGGAGGACAACCTGGATCTGCCCCATCTTCTGCCCCACCTGAACAGTCCCTGCT

GGATTGGAAGTTCGAGATGAGCTACACCGTCGGCGGACCTCCACCTCATGTTCATGCCAGACCTCGGCACT

GGAAAACCGACAGAGATGGCCACAGCTACACCAGCAAAGTGAACTGCCTCCTGCTGCAGGATGGCTTCCAC

GGCTGTGTGTCTATTACTGGCGCCGCTGGCAGACGGAACCTGAGCATCTTTCTGTTTCTGATGCTGTGCAA

GCTCGAGTTCCACGCCTGCAAGATCCAGAACAAGAACTGCCCCGACTTCAAGAAGTTCGACGGCCCTTGCG

GAGAAAGAGGCGGAGGCAGAACAGCTAGAGCCCTTTGGGCTAGAGGCGACAGCGTTCTGACACCAGCTCTG

GACCCTCAGACACCTGTTAGGGCCCCTAGCCTGACAAGAGCTGCCGCCGCTGTGCACTACAAGCTGATCCA

GCAGCCAATCAGCCTGTTCAGCATCACCGACCGGCTGCACAAGACATTCAGCCAGCTGCCAAGCGTGCACC

TGTGCTCCATCACCTTCCAGTGGGGACACCCTCCTATCTTTTGCTCCACCAACGACATCTGCGTGACCGCC

AACTTCTGTATCAGCGTGACCTTCCTGAAGCCTTGCTTTCTGCTGCACGAGGCCAGCGCCTCTCAGTGCCA

-continued

CTTGTTTCTGCAGCCCCAAGTGGGCACACCTCCTCCACATACAGCCTCTGCTAGAGCACCTAGCGGCCCTC

CACATCCTCACGAATCTTGTCCTGCCGGAAGAAGGCCTGCCAGAGCCGCTCAAACATGTGCCAGACGACAG

CACGGACTGCCTGGATGTGAAGAGGCTGGAACAGCCAGAGTGCCTAGCCTGCACCTCCATCTGCATCAGGC

TGCTCTTGGAGCCGGAAGAGGTAGAGGATGGGGCGAAGCTTGTGCTCAGGTGCCACCTTCTAGAGGCGTGC

TGAGATTCCTGGACCTGAAAGTGCGCTACCTGCACAGCCAGTGGCAGCACTATCACAGATCTGGCGAAGCC

GCCGGAACACCCCTTTGGAGGCCAACAAGAAACGTGCCCTTCCGGGAACTGAAGAACCAGAGAACAGCTCA

GGGCGCTCCTGGAATCCACCATGCTGCTTCTCCAGTGGCCGCCAACCTGTGTGATCCTGCCAGACATGCCC

AGCACACCAGGATTCCTTGTGGCGCTGGACAAGTGCGCGCTGGAAGAGGACCTGAAGCAGGCGGAGGTGTT

CTGCAACCTCAAAGACCCGCTCCTGAGAAGCCTGGCTGCCCTTGCAGAAGAGGACAGCCTAGACTGCACAC

CGTGAAAATGTGGCGAGCCGTGGCCATGATGGTGCCCGATAGACAGGTCCACTACGACTTTGGACTGGGCG

TGCCAGGCGATAGCACTCGGAGAGCCGTCAGACGGATGAACACCTTTTACGAAGCCGGGATGACCCTGGGC

GAGAAGTTCAGAGTGGGCAACTGCAAGCACCTGAAGATGACCCGGCCTAACAGCAAGATGGCCCTGAATAG

CGAGGCCCTGTCTGTGGTGTCTGAATGTGGCGCCTCTGCCTGTGACGTGTCCCTGATCGCTATGGACTCCG

CCTTTGTGCAGGGCAAAGACTGGGGCGTGAAGAAGTTCATCCGGCGGGACTTCTACGCCTACAAGGACTTC

CTGTGGTGCTTCCCCTTCTCTCTGGTGTTCCTGCAAGAGATCCAGATCTGCTGTCATGTGTCCTGCCTGTG

CTGCATCTGCTGTAGCACCAGAATCTGCCTGGGCTGTCTGCTGGAACTGTTCCTGAGCAGAGCCCTGAGAG

CACTGCACGTGCTGTGGAACGGATTCCAGCTGCACTGCCAGACCGAGTACAACCAGAAACTGCAAGTGAAC

CAGTTCAGCGAGAGCAAGAGCCTGTACCACCGGGAAAAGCAGCTCATTGCCATGGACAGCGCCATCTGCGA

AGAGAGAGGCGCCGCAGGATCTCTGATCTCCTGCGAAACAATGCCCGCCATCCTGAAGCTGCAGAAGAATT

GCCTCCTAAGCCTGCGAACCGCTCTGACACACAACCAGGACTTCAGCATCTACAGACTGTGTTGCAAGCGG

GGCTCCCTGTGCCATGCAAGCCAAGCTAGAAGCCCCGCCTTTCCTAAACCTGTGCGACCTCTGCCAGCTCC

AATCACCAGAATTACCCCTCAGCTCGGCGGCCAGAGCGATTCATCTCAACCTCTGCTGACCACCGGCAGAC

CTCAAGGCTGGCAAGACCAAGCTCTGAGACACACCCAGCAGGCTAGCCCTGCCTCTTGTGCCACCATCACA

ATCCCCATCCACTCTGCCGCTCTGGGCGATCATTCTGGCGATCCTGGACCAGCCTGGGACACATGTCCTCC

ACTGCCACTCACAACACTGATCCCTAGGGCTCCTCCACCTTACGGCGATTCTACCGCTAGAAGCTGGCCCA

GCAGATGTGGACCACTCGGAGGCAACACAACCCTCCAGCAACTGGGAGAAGCCTCTCAGGCTCCTAGCGGC

TCTCTGATCCCTCTCAGACTGCCTCTCCTGTGGGAAGTTCGGGGCCAGCCTGATTCTTTTGCCGCACTGCA

CAGCTCCCTGAACGAGCTGGGAGAGATCGCTAGAGAGCTGCACCAGTTCGCCTTCGACCTGCTGATCAAGA

GCCACTTCGTGCAAGGCAAGGATTGGGGCCTCAAAAAGTTTATCCGCAGAGACTTCTGGGGCATGGAACTG

GCCGCCAGCAGAAGATTCAGCTGGGATCATCATAGCGCAGGCGGCCCACCTAGAGTGCCATCTGTTAGAAG

CGGAGCTGCCCAGGTGCAGCCTAAAGATCCTCTGCCACTGAGAACACTGGCCGGCTGCCTTGCTAGAACAG

CCCATCTTAGACCTGGCGCCGAGTCTCTGCCTCAGCCACAACTGCACTGTACCCTGTGGTTCCAGTCCAGC

GAGCTGTCTCCTACTGGTGCCCCTTGGCCATCTAGACGCCCTACTTGGAGAGGCACCACCGTGTCACCAAG

AACCGCCACAAGCAGCGCCAGAACCTGTTGTGGCACAAAGTGGCCCTCCAGCCAAGAAGCCGCTCTCGGAC

TTGGAAGCGGACTGCTGAGGTTCTCTTGTGGAACCGCCGCCATTCGGAAGATGCACTTTAGCCTGAAAGAA

CACCCTCCACCACCTTGTCCTCCAGAGGCTTTCCAAAGAGCTGCTGGCGAAGGCGGACCTGGTAGAGGTGG

TGCTAGAAGAGGTGCTAGGGTGCTGCAGAGCCCATTCTGTAGAGCAGGCGCAGGCGAATGGCTGGGCCATC

AGAGTCTGAGACATGTCGTCGGCTACGGCCACCTGGATACAAGCGGAAGCAGCTCTAGCTCCAGCTGGCCT

AACTCAAAAATGGCTCTGAACAGCCTGAACTCCATCGACGACGCCCAGCTGACAAGAATCGCCCCTCCTAG

ATCTCACTGCTGCTTTTGGGAAGTGAACGCCCCAAGCCATCACCATCACCACCATTAGTAAAGGCGCGCCT

-continued

AGCGGCCGCgatctgctgtgccttctagttgccagccatctgttgtttgcccctcccccgtgccttccttg accctggaaggtgccactcccactgtcctttcctaataaaatgaggaaattgcatcgcattgtctgagtag gtgtcattctattctggggggtggggtggggcaggacagcaagggggaggattgggaagacaatagcaggc atgctggggatgcggtgggctctatggcc neoMVA expression cassette protein

SEQ ID NO: 552

MGQKEQIHTLQKNSERMSKQLTRSSQAVQNLQNGGGSRSSATLPGRRRRRWLRRRRQPISVAPAG

PPRRPNQKPNPPGGARCVIMRPTWPGTSAFTGMECTLGQVGAPSPRREEDGWRGGHSRFKADVPAPQGPCW

GGQPGSAPSSAPPEQSLLDDYWAQKEKISIPRTHLCWKFEMSYTVGGPPPHVHARPRHWKTDRDYWAQKEK

GSSSFLRPSCVPFRELKNVSVLEGLRQGRLGGPCSCHCPRPSQARLTPVDVAGPFLCLGDPGLFPPVKSSI

TEISCCTLSSEENEYLPRPEWQLQYEAGMTLGGKILFFLFLLLPLSPFSLIFLVLGVLSGHSGSRLKRSFA

VTERIITGGKSTCSAPGPQSLPSTPFSTYPQWVILITELDGHSYTSKVNCLLLQDGFHGCVSITGAAGRRN

LSIFLFLMLCKLEFHACQWQHYHRSGEAAGTPLWRPTRNVAMMVPDRQVHYDFGLKIQNKNCPDVLRFLDL

KVRYLHSVPFRELKNQRTAQGAPGIHHAASPVAANLCDPARHAQHTRIPCGAGQVRAGRGPEAGGGVLQPQ

RPAPEKPGCPCRRGQPRLHTVKMWRACHLFLQPQVGTPPPHTASARAPSGPPHPHESCPAGRRPARAAQTC

ARRQHGLPGCEEAGTARVPSLHLHLHQAALGAGRGRGWGEACAQVPPSRGHYKLIQQPISLFSITDRLHKT

FSQLPSVHLCSITFQWGHPPIFCSTNDICVTANFCISVTFLKPCFLLHEASASQFKKFDGPCGERGGGRTA

RALWARGDSVLTPALDPQTPVRAPSLTRAAAAVGVPGDSTRRAVRRMNTFCGASACDVSLIAMDSACEERG

AAGSLISCESLYHREKQLIAMDSAIFVQGKDWGVKKFIRRDFTMPAILKLQKNCLLSLNSKMALNSEALSV

VSEYEAGMTLGEKFRVGNCKHLKMTRPTEYNQKLQVNQFSESKRTALTHNQDFSIYRLCCKRGSLCHASQA

RSPAFPKPVRPLPAPITRITPQLGGQSDSSQPLLTTGRPQGWQDQALRHTQQASPASCATITIPIHSAALG

DHSGDPGPAWDTCPPLPLTTLIPRAPPPYGDSTARSWPSRCGPLGYAYKDFLWCFPFSLVFLQEIQICCHV

SCLCCICCSTRICLGCLLELFLSRALRALHVLWNGFQLHCQGNTTLQQLGEASQAPSGSLIPLRLPLLWEV

RGNSKMALNSLNSIDDAQLTRIAPPRSHCCFWEVNAPFVQGKDWGLKKFIRRDFEAFQRAAGEGGPGRGGA

RRGARVLQSPFCRAGAGEWLGHQSLRWGMELAASRRFSWDHHSAGGPPRVPSVRSGAAQVQPKDPLPLRTL

AGCLARTAHLRPGAESLPQPQLHCTIARELHQFAFDLLIKSHKMHFSLKEHPPPPCPPHVVGYGHLDTSGS

SSSSSWPQPDSFAALHSSLNELGELWFQSSELSPTGAPWPSRRPTWRGTTVSPRTATSSARTCCGTKWPSS

QEAALGLGSGLLRFSCGTAAIR neoMVA expression cassette polynucleotide

SEQ ID NO: 553 gatcactaattccaaacccacccgctttttatagtaagtttttcacccataaataataaatacaa taattaatttctcgtaaaagtagaaaatatattctaatttattgcacggtaaggaagtagaatcataaaga acagtgacGGATCCCGCGACTTCGCCGCCATGGGCCAGAAAGAGCAGATCCACACACTGCAGAAAAACAGC

GAGCGGATGAGCAAGCAGCTGACCAGATCTTCTCAGGCCGTGCAGAACCTGCAGAACGGCGGAGGCTCTAG

AAGCTCTGCTACACTTCCTGGCAGGCGGCGGAGAAGATGGCTGAGAAGAAGGCGGCAGCCTATCTCTGTGG

CTCCTGCTGGACCTCCTAGACGGCCCAACCAGAAGCCTAATCCTCCTGGCGGAGCCAGATGCGTGATCATG

AGGCCTACATGGCCTGGCACCAGCGCCTTTACCGGCATGGAATGTACACTGGGCCAAGTGGGAGCCCCATC

TCCTAGAAGAGAAGAGGATGGCTGGCGCGGAGGCCACTCTAGATTCAAAGCTGATGTGCCCGCTCCTCAGG

GCCCTTGTTGGGGAGGACAACCTGGATCTGCCCCATCTTCTGCCCCACCTGAACAGAGCCTGCTGGATGAC

TATTGGGCTCAAAAAGAGAAGATCAGCATCCCCAGAACACACCTGTGCTGGAAGTTCGAGATGAGCTACAC

CGTTGGCGGCCCTCCACCACATGTTCACGCCAGACCTAGACACTGGAAAACCGACAGAGATTATTGGGCCC

AGAAAGAAAAGGGCAGCAGCAGCTTCCTGCGGCCTAGCTGTGTGCCCTTCCGGGAACTGAAGAACGTGTCC

GTTCTGGAAGGCCTGAGGCAGGGCAGACTTGGCGGACCTTGTAGCTGCCACTGTCCTAGACCAAGCCAGGC

-continued

CAGACTGACCCCTGTGGATGTGGCTGGCCCATTTCTGTGTCTGGGCGACCCTGGACTGTTCCCTCCAGTGA

AGTCTAGCATCACCGAGATCAGCTGCTGCACCCTGAGCAGCGAGGAAAACGAGTACCTGCCTAGACCTGAA

TGGCAGCTGCAGTACGAGGCCGGCATGACACTCGGAGGCAAGATCCTGTTCTTCCTGTTCCTGCTGCTCCC

TCTGAGCCCCTTCAGCCTGATCTTTCTGGTGCTGGGCGTGCTGTCTGGCCACTCTGGAAGCAGACTGAAGA

GAAGCTTCGCCGTGACCGAGCGGATCATCACAGGCGGCAAGAGCACATGTTCTGCCCCTGGACCTCAGTCT

CTGCCCAGCACACCCTTCAGCACATACCCTCAGTGGGTCATCCTGATCACCGAGCTGGATGGCCACAGCTA

CACCAGCAAAGTGAACTGCCTCCTGCTGCAGGATGGCTTCCACGGCTGTGTGTCTATTACTGGCGCCGCTG

GCAGACGGAACCTGAGCATCTTTCTGTTTCTGATGCTGTGCAAGCTCGAGTTCCACGCCTGCCAATGGCAG

CACTACCACAGATCTGGCGAAGCCGCTGGAACCCCACTTTGGAGGCCTACCAGAAACGTGGCCATGATGGT

GCCCGACAGACAGGTGCACTACGACTTCGGCCTGAAGATCCAGAACAAGAACTGCCCCGACGTGCTGCGGT

TCCTGGATCTCAAAGTGCGCTACCTGCACAGCGTGCCCTTCAGAGAGCTGAAAAACCAGAGAACAGCCCAG

GGCGCTCCTGGAATCCATCATGCTGCTTCTCCAGTGGCCGCCAATCTGTGCGATCCTGCCAGACATGCCCA

GCATACCAGGATTCCTTGTGGCGCTGGACAAGTGCGCGCTGGAAGAGGACCTGAAGCTGGTGGCGGAGTTC

TGCAGCCTCAAAGACCTGCTCCTGAGAAGCCTGGCTGCCCCTGTAGAAGAGGACAGCCTAGACTGCACACC

GTGAAGATGTGGCGGGCCTGCCACTTGTTTCTCCAGCCACAAGTGGGCACCCCTCCACCTCATACAGCCTC

TGCTAGAGCACCTAGCGGCCCACCTCATCCTCACGAATCTTGTCCTGCCGGAAGAAGGCCTGCCAGAGCCG

CTCAAACATGTGCCAGACGACAGCACGGACTGCCCGGATGTGAAGAAGCCGGAACAGCCAGAGTGCCTAGC

CTGCACCTTCATCTGCATCAGGCCGCTCTTGGAGCCGGAAGAGGTAGAGGATGGGGAGAAGCTTGTGCCCA

GGTGCCACCTTCTAGAGGCCACTACAAGCTGATCCAGCAGCCAATCAGCCTGTTCTCCATCACCGACCGGC

TGCACAAGACATTCAGCCAGCTGCCTTCCGTGCATCTGTGCAGCATCACCTTCCAGTGGGGACACCCTCCT

ATCTTTTGCTCCACCAACGACATCTGCGTGACCGCCAACTTCTGTATCAGCGTGACCTTCCTGAAGCCTTG

CTTTCTGCTGCACGAGGCCTCCGCCAGCCAGTTTAAGAAGTTTGACGGCCCCTGCGGCGAGAGAGGCGGAG

GAAGAACTGCAAGAGCCCTTTGGGCCAGAGGCGACTCTGTTCTGACACCAGCTCTGGACCCTCAGACACCT

GTTAGGGCCCCTAGCCTGACAAGAGCTGCCGCTGCTGTTGGAGTGCCTGGCGATTCTACTAGAAGGGCCGT

GCGGCGGATGAACACCTTTTGTGGCGCATCTGCCTGCGACGTGTCCCTGATCGCTATGGATAGCGCCTGCG

AGGAAAGAGGCGCAGCCGGATCTCTGATCTCTTGCGAGAGCCTGTACCACCGGGAAAAGCAGCTCATTGCC

ATGGACAGCGCCATCTTCGTGCAGGGCAAAGACTGGGGCGTGAAGAAGTTCATCCGGCGGGACTTTACCAT

GCCTGCCATTCTGAAGCTGCAGAAGAATTGTCTTCTAAGCCTGAACAGCAAGATGGCCCTGAATAGCGAGG

CCCTGTCTGTGGTGTCCGAGTATGAGGCTGGAATGACCCTGGGCGAGAAGTTCAGAGTGGGCAACTGCAAG

CACCTGAAGATGACCCGGCCTACCGAGTACAACCAGAAACTGCAAGTGAACCAGTTCAGCGAGAGCAAGCG

GACCGCTCTGACCCACAACCAGGACTTCAGCATCTACCGGCTGTGCTGCAAGAGGGGCTCTCTGTGTCATG

CTAGCCAGGCTAGAAGCCCCGCCTTTCCTAAGCCTGTCAGACCTCTGCCTGCTCCTATCACCAGAATCACC

CCTCAGCTCGGCGGCCAGTCTGATTCATCTCAGCCACTGCTGACCACCGGCAGACCTCAAGGATGGCAAGA

CCAGGCTCTGAGACACACACAGCAGGCTAGCCCAGCCTCTTGCGCCACCATCACAATACCAATACATTCTG

CCGCTCTGGGCGATCACAGCGGAGATCCTGGACCTGCCTGGGATACTTGTCCTCCTCTGCCCCTAACTACA

CTGATCCCTAGGGCTCCTCCACCTTACGGCGATAGCACAGCCAGATCCTGGCCTAGCAGATGTGGCCCTCT

GGGCTACGCCTACAAGGACTTCCTGTGGTGCTTCCCCTTCTCTCTGGTGTTCCTGCAAGAAATCCAGATCT

GCTGTCACGTGTCCTGCCTGTGCTGTATCTGCTGTAGCACCCGGATCTGTCTGGGCTGTCTGCTGGAACTG

TTCCTGAGCAGAGCCCTGAGAGCACTGCACGTGCTGTGGAACGGATTCCAGCTGCACTGCCAGGGCAACAC

CACACTGCAACAGCTGGGAGAAGCCTCTCAGGCCCCAAGCGGTTCTCTGATCCCTCTCAGACTGCCCCTCC

-continued

TGTGGGAAGTGCGGGGCAATTCTAAGATGGCTCTCAACAGCCTGAACTCCATCGACGACGCCCAGCTGACA

AGAATCGCCCCTCCAAGAAGCCACTGTTGCTTTTGGGAAGTGAACGCCCCTTTTGTGCAGGGTAAAGATTG

GGGCCTCAAAAAGTTTATCAGACGGGACTTCGAGGCTTTCCAGAGAGCAGCTGGCGAAGGCGGACCTGGCA

GAGGTGGTGCTAGAAGAGGTGCTAGAGTGCTGCAGAGCCCATTCTGTAGAGCTGGCGCTGGCGAATGGCTG

GGCCACCAATCTCTTAGATGGGGAATGGAACTGGCCGCTAGCAGGCGGTTTAGCTGGGATCATCATTCTGC

CGGCGGACCTCCAAGAGTGCCAAGCGTTAGAAGCGGAGCAGCCCAGGTCCAGCCTAAAGATCCACTGCCAC

TGAGAACACTGGCCGGCTGCCTTGCCAGAACAGCTCATCTTAGACCTGGCGCCGAAAGCCTGCCTCAACCT

CAGCTGCATTGCACAATCGCCAGAGAACTGCACCAGTTCGCCTTCGACCTGCTGATCAAGAGCCACAAGAT

GCACTTCTCACTGAAAGAGCACCCGCCACCGCCGTGCCCACCGCACGTTGTCGGCTATGGCCACCTGGATA

CAAGCGGCTCCTCTAGCAGTAGCTCCTGGCCTCAGCCTGACAGCTTTGCTGCCCTGCATAGCTCCCTGAAT

GAGCTGGGCGAACTGTGGTTCCAGTCCAGCGAACTGTCTCCTACTGGCGCTCCATGGCCAAGCAGAAGGCC

TACTTGGAGAGGCACCACCGTGTCTCCAAGAACCGCTACAAGCAGCGCCAGAACCTGTTGCGGCACAAAAT

GGCCCTCCAGCCAAGAAGCTGCCCTCGGACTTGGAAGCGGACTGCTGAGATTCAGCTGTGGCACAGCCGCC

ATCAGAAGCCATCACCATCACCACCATTAGTAAAGGCGCGCC

The amino acid sequence of additional five neoantigen layouts for GAd20 expression are shown in SEQ ID NOs: 554, 555, 556, 623 and 624.

SEQ ID NO: 554

MGQKEQIHTLQKNSERMSKQLTRSSQAVQNLQNGGGSRSSATLPGRRRRRWLRRRRQPISVAPAG

PPRRPNQKPNPPGGARCVIMRPTWPGTSAFTKRSFAVTERIILVLGVLSGHSGSRLYEAGMTLGGKILFFL

FLLLPLSPFSLIFTEISCCTLSSEENEYLPRPEWQLQVPFRELKNVSVLEGLRQGRLGGPCSCHCPRPSQA

RLTPVDVAGPFLCLGDPGLFPPVKSSITGGKSTCSAPGPQSLPSTPFSTYPQWVILITELGMECTLGQVGA

PSPRREEDGWRGGHSRFKADVPAPQGPCWGGQPGSAPSSAPPEQSLLDDYWAQKEKGSSSFLRPSCDYWAQ

KEKISIPRTHLCWKFEMSYTVGGPPPHVHARPRHWKTDRGVPGDSTRRAVRRMNTFYEAGMTLGEKFRVGN

CKHLKMTRPNSKMALNSEALSVVSECGASACDVSLIAMDSAFVQGKDWGVKKFIRRDFYAYKDFLWCFPFS

LVFLQEIQICCHVSCLCCICCSTRICLGCLLELFLSRALRALHVLWNGFQLHCQTEYNQKLQVNQFSESKS

LYHREKQLIAMDSAICEERGAAGSLISCETMPAILKLQKNCLLSLRTALTHNQDFSIYRLCCKRGSLCHAS

QARSPAFPKPVRPLPAPITRITPQLGGQSDSSQPLLTTGRPQGWQDQALRHTQQASPASCATITIPIHSAA

LGDHSGDPGPAWDTCPPLPLTTLIPRAPPPYGDSTARSWPSRCGPLGDGHSYTSKVNCLLLQDGFHGCVSI

TGAAGRRNLSIFLFLMLCKLEFHACKIQNKNCPDFKKFDGPCGERGGGRTARALWARGDSVLTPALDPQTP

VRAPSLTRAAAAVHYKLIQQPISLFSITDRLHKTFSQLPSVHLCSITFQWGHPPIFCSTNDICVTANFCIS

VTFLKPCFLLHEASASQCHLFLQPQVGTPPPHTASARAPSGPPHPHESCPAGRRPARAAQTCARRQHGLPG

CEEAGTARVPSLHLHLHQAALGAGRGRGWGEACAQVPPSRGVLRFLDLKVRYLHSQWQHYHRSGEAAGTPL

WRPTRNVPFRELKNQRTAQGAPGIHHAASPVAANLCDPARHAQHTRIPCGAGQVRAGRGPEAGGGVLQPQR

PAPEKPGCPCRRGQPRLHTVKMWRAVAMMVPDRQVHYDFGLGNTTLQQLGEASQAPSGSLIPLRLPLLWEV

RGQPDSFAALHSSLNELGEIARELHQFAFDLLIKSHFVQGKDWGLKKFIRRDFWGMELAASRRFSWDHHSA

GGPPRVPSVRSGAAQVQPKDPLPLRTLAGCLARTAHLRPGAESLPQPQLHCTLWFQSSELSPTGAPWPSRR

PTWRGTTVSPRTATSSARTCCGTKWPSSQEAALGLGSGLLRFSCGTAAIRKMHFSLKEHPPPPCPPEAFQR

AAGEGGPGRGGARRGARVLQSPFCRAGAGEWLGHQSLRHVVGYGHLDTSGSSSSSSWPNSKMALNSLNSID

DAQLTRIAPPRSHCCFWEVNAP

-continued

SEQ ID NO: 555
MGQKEQIHTLQKNSERMSKQLTRSSQAVQNLQNGGGSRSSATLPGRRRRRWLRRRRQPISVAPAGPPRRPN
QKPNPPGGARCVIMRPTWPGTSAFTKRSFAVTERIITEISCCTLSSEENEYLPRPEWQLQYEAGMTLGGKI
LFFLFLLLPLSPFSLIFDYWAQKEKGSSSFLRPSCVPFRELKNVSVLEGLRQGRLGGPCSCHCPRPSQARL
TPVDVAGPFLCLGDPGLFPPVKSSITGGKSTCSAPGPQSLPSTPFSTYPQWVILITELGMECTLGQVGAPS
PRREEDGWRGGHSRFKADVPAPQGPCWGGQPGSAPSSAPPEQSLLDDYWAQKEKISIPRTHLCLVLGVLSG
HSGSRLWKFEMSYTVGGPPPHVHARPRHWKTDRDGHSYTSKVNCLLLQDGFHGCVSITGAAGRRNLSIFLF
LMLCKLEFHACKIQNKNCPDFKKFDGPCGERGGGRTARALWARGDSVLTPALDPQTPVRAPSLTRAAAAVH
YKLIQQPISLFSITDRLHKTFSQLPSVHLCSITFQWGHPPIFCSTNDICVTANFCISVTFLKPCFLLHEAS
ASQCHLFLQPQVGTPPPHTASARAPSGPPHPHESCPAGRRPARAAQTCARRQHGLPGCEEAGTARVPSLHL
HLHQAALGAGRGRGWGEACAQVPPSRGVLRFLDLKVRYLHSQWQHYHRSGEAAGTPLWRPTRNVPFRELKN
QRTAQGAPGIHHAASPVAANLCDPARHAQHTRIPCGAGQVRAGRGPEAGGGVLQPQRPAPEKPGCPCRRGQ
PRLHTVKMWRAVAMMVPDRQVHYDFGLGVPGDSTRRAVRRMNTFYEAGMTLGEKFRVGNCKHLKMTRPNSK
MALNSEALSVVSECGASACDVSLIAMDSAFVQGKDWGVKKFIRRDFYAYKDFLWCFPFSLVFLQEIQICCH
VSCLCCICCSTRICLGCLLELFLSRALRALHVLWNGFQLHCQTEYNQKLQVNQFSESKSLYHREKQLIAMD
SAICEERGAAGSLISCETMPAILKLQKNCLLSLRTALTHNQDFSIYRLCCKRGSLCHASQARSPAFPKPVR
PLPAPITRITPQLGGQSDSSQPLLTTGRPQGWQDQALRHTQQASPASCATITIPIHSAALGDHSGDPGPAW
DTCPPLPLTTLIPRAPPPYGDSTARSWPSRCGPLGGNTTLQQLGEASQAPSGSLIPLRLPLLWEVRGQPDS
FAALHSSLNELGEIARELHQFAFDLLIKSHFVQGKDWGLKKFIRRDFWGMELAASRRFSWDHHSAGGPPRV
PSVRSGAAQVQPKDPLPLRTLAGCLARTAHLRPGAESLPQPQLHCTLWFQSSELSPTGAPWPSRRPTWRGT
TVSPRTATSSARTCCGTKWPSSQEAALGLGSGLLRFSCGTAAIRKMHFSLKEHPPPPCPPEAFQRAAGEGG
PGRGGARRGARVLQSPFCRAGAGEWLGHQSLRHVVGYGHLDTSGSSSSSSWPNSKMALNSLNSIDDAQLTR
IAPPRSHCCFWEVNAP

SEQ ID NO: 556
MGQKEQIHTLQKNSERMSKQLTRSSQAVQNLQNGGGSRSSATLPGRRRRRWLRRRRQPISVAPAG
PPRRPNQKPNPPGGARCVIMRPTWPGTSAFTKRSFAVTERIIDYWAQKEKGSSSFLRPSCVPFRELKNVSV
LEGLRQGRLGGPCSCHCPRPSQARLTPVDVAGPFLCLGDPGLFPPVKSSILVLGVLSGHSGSRLYEAGMTL
GGKILFFLFLLLPLSPFSLIFTEISCCTLSSEENEYLPRPEWQLQTGGKSTCSAPGPQSLPSTPFSTYPQW
VILITELGMECTLGQVGAPSPRREEDGWRGGHSRFKADVPAPQGPCWGGQPGSAPSSAPPEQSLLDDYWAQ
KEKISIPRTHLCWKFEMSYTVGGPPPHVHARPRHWKTDRDGHSYTSKVNCLLLQDGFHGCVSITGAAGRRN
ISIFLFLMLCKLEFHACKIQNKNCPDFKKFDGPCGERGGGRTARALWARGDSVLTPALDPQTPVRAPSLTR
AAAAVHYKLIQQPISLFSITDRLHKTFSQLPSVHLCSITFQWGHPPIFCSTNDICVTANFCISVTFLKPCF
LLHEASASQCHLFLQPQVGTPPPHTASARAPSGPPHPHESCPAGRRPARAAQTCARRQHGLPGCEEAGTAR
VPSLHLHLHQAALGAGRGRGWGEACAQVPPSRGVLRFLDLKVRYLHSQWQHYHRSGEAAGTPLWRPTRNVP
FRELKNQRTAQGAPGIHHAASPVAANLCDPARHAQHTRIPCGAGQVRAGRGPEAGGGVLQPQRPAPEKPGC
PCRRGQPRLHTVKMWRAVAMMVPDRQVHYDFGLGVPGDSTRRAVRRMNTFYEAGMTLGEKFRVGNCKHLKM
TRPNSKMALNSEALSVVSECGASACDVSLIAMDSAFVQGKDWGVKKFIRRDFYAYKDFLWCFPFSLVFLQE
IQICCHVSCLCCICCSTRICLGCLLELFLSRALRALHVLWNGFQLHCQTEYNQKLQVNQFSESKSLYHREK
QLIAMDSAICEERGAAGSLISCETMPAILKLQKNCLLSLRTALTHNQDFSIYRLCCKRGSLCHASQARSPA
FPKPVRPLPAPITRITPQLGGQSDSSQPLLTTGRPQGWQDQALRHTQQASPASCATITIPIHSAALGDHSG
DPGPAWDTCPPLPLTTLIPRAPPPYGDSTARSWPSRCGPLGGNTTLQQLGEASQAPSGSLIPLRLPLLWEV

-continued

RGQPDSFAALHSSLNELGEIARELHQFAFDLLIKSHFVQGKDWGLKKFIRRDFWGMELAASRRFSWDHHSA

GGPPRVPSVRSGAAQVQPKDPLPLRTLAGCLARTAHLRPGAESLPQPQLHCTLWFQSSELSPTGAPWPSRR

PTWRGTTVSPRTATSSARTCCGTKWPSSQEAALGLGSGLLRFSCGTAAIRKMHFSLKEHPPPPCPPEAFQR

AAGEGGPGRGGARRGARVLQSPFCRAGAGEWLGHQSLRHVVGYGHLDTSGSSSSSSWPNSKMALNSLNSID

DAQLTRIAPPRSHCCFWEVNAP

SEQ ID NO: 623

MGQKEQIHTLQKNSERMSKQLTRSSQAVGVPGDSTRRAVRRMNTFYEAGMTLGEKFRVGNCKHLKMTRPNS

KMALNSEALSVVSECGASACDVSLIAMDSAFVQGKDWGVKKFIRRDFYAYKDFLWCFPFSLVFLQEIQICC

HVSCLCCICCSTRICLGCLLELFLSRALRALHVLWNGFQLHCQTEYNQKLQVNQFSESKSLYHREKQLIAM

DSAICEERGAAGSLISCETMPAILKLQKNCLLSLRTALTHNQDFSIYRLCCKRGSLCHASQARSPAFPKPV

RPLPAPITRITPQLGGQSDSSQPLLTTGRPQGWQDQALRHTQQASPASCATITIPIHSAALGDHSGDPGPA

WDTCPPLPLTTLIPRAPPPYGDSTARSWPSRCGPLGGNTTLQQLGEASQAPSGSLIPLRLPLLWEVRGQPD

SFAALHSSLNELGEIARELHQFAFDLLIKSHFVQGKDWGLKKFIRRDFWGMELAASRRFSWDHHSAGGPPR

VPSVRSGAAQVQPKDPLPLRTLAGCLARTAHLRPGAESLPQPQLHCTLWFQSSELSPTGAPWPSRRPTWRG

TTVSPRTATSSARTCCGTKWPSSQEAALGLGSGLLRFSCGTAAIRKMHFSLKEHPPPPCPPEAFQRAAGEG

GPGRGGARRGARVLQSPFCRAGAGEWLGHQSLRHVVGYGHLDTSGSSSSSSWPNSKMALNSLNSIDDAQLT

RIAPPRSHCCFWEVNAPDGHSYTSKVNCLLLQDGFHGCVSITGAAGRRNLSIFLFLMLCKLEFHACKIQNK

NCPDFKKFDGPCGERGGGRTARALWARGDSVLTPALDPQTPVRAPSLTRAAAAVHYKLIQQPISLFSITDR

LHKTFSQLPSVHLCSITFQWGHPPIFCSTNDICVTANFCISVTFLKPCFLLHEASASQCHLFLQPQVGTPP

PHTASARAPSGPPHPHESCPAGRRPARAAQTCARRQHGLPGCEEAGTARVPSLHLHLHQAALGAGRGRGWG

EACAQVPPSRGVLRFLDLKVRYLHSQWQHYHRSGEAAGTPLWRPTRNVPFRELKNQRTAQGAPGIHHAASP

VAANLCDPARHAQHTRIPCGAGQVRAGRGPEAGGGVLQPQRPAPEKPGCPCRRGQPRLHTVKMWRAVAMMV

PDRQVHYDFGLQNLQNGGGSRSSATLPGRRRRRWLRRRRQPISVAPAGPPRRPNQKPNPPGGARCVIMRPT

WPGTSAFTKRSFAVTERIILVLGVLSGHSGSRLYEAGMTLGGKILFFLFLLLPLSPFSLIFTEISCCTLSS

EENEYLPRPEWQLQVPFRELKNVSVLEGLRQGRLGGPCSCHCPRPSQARLTPVDVAGPFLCLGDPGLFPPV

KSSITGGKSTCSAPGPQSLPSTPFSTYPQWVILITELGMECTLGQVGAPSPRREEDGWRGGHSRFKADVPA

PQGPCWGGQPGSAPSSAPPEQSLLDDYWAQKEKGSSSFLRPSCDYWAQKEKISIPRTHLCWKFEMSYTVGG

PPPHVHARPRHWKTDR

SEQ ID NO: 624

MGQKEQIHTLQKNSERMSKQLTRSSQAVGNTTLQQLGEASQAPSGSLIPLRLPLLWEVRGQPDSFAALHSS

LNELGEIARELHQFAFDLLIKSHFVQGKDWGLKKFIRRDFWGMELAASRRFSWDHHSAGGPPRVPSVRSGA

AQVQPKDPLPLRTLAGCLARTAHLRPGAESLPQPQLHCTLWFQSSELSPTGAPWPSRRPTWRGTTVSPRTA

TSSARTCCGTKWPSSQEAALGLGSGLLRFSCGTAAIRKMHFSLKEHPPPPCPPEAFQRAAGEGGPGRGGAR

RGARVLQSPFCRAGAGEWLGHQSLRHVVGYGHLDTSGSSSSSSWPNSKMALNSLNSIDDAQLTRIAPPRSH

CCFWEVNAPGVPGDSTRRAVRRMNTFYEAGMTLGEKFRVGNCKHLKMTRPNSKMALNSEALSVVSECGASA

CDVSLIAMDSAFVQGKDWGVKKFIRRDFYAYKDFLWCFPFSLVFLQEIQICCHVSCLCCICCSTRICLGCL

LELFLSPALRALHVLWNGFQLHCQTEYNQKLQVNQFSESKSLYHREKQLIAMDSAICEERGAAGSLISCET

MPAILKLQKNCLLSLRTALTHNQDFSIYRLCCKRGSLCHASQARSPAFPKPVRPLPAPITRITPQLGGQSD

SSQPLLTTGRPQGWQDQALRHTQQASPASCATITIPIHSAALGDHSGDPGPAWDTCPPLPLTTLIPRAPPP

YGDSTARSWPSRCGPLGDGHSYTSKVNCLLLQDGFHGCVSITGAAGRRNLSIFLFLMLCKLEFHACKIQNK

NCPDFKKFDGPCGERGGGRTARALWARGDSVLTPALDPQTPVRAPSLTRAAAAVHYKLIQQPISLFSITDR

LHKTFSQLPSVHLCSITFQWGHPPIFCSTNDICVTANFCISVTFLKPCFLLHEASASQCHLFLQPQVGTPP

-continued

PHTASARAPSGPPHPHESCPAGRRPARAAQTCARRQHGLPGCEEAGTARVPSLHLHLHQAALGAGRGRGWG
EACAQVPPSRGVLRFLDLKVRYLHSQWQHYHRSGEAAGTPLWRPTRNVPFRELKNQRTAQGAPGIHHAASP
VAANLCDPARHAQHTRIPCGAGQVRAGRGPEAGGGVLQPQRPAPEKPGCPCRRGQPRLHTVKMWRAVAMMV
PDRQVHYDFGLQNLQNGGGSRSSATLPGRRRRRWLRRRRQPISVAPAGPPRRPNQKPNPPGGARCVIMRPT
WPGTSAFTKRSFAVTERIITEISCCTLSSEENEYLPRPEWQLQYEAGMTLGGKILFFLFLLLPLSPFSLIF
DYWAQKEKGSSSFLRPSCVPFRELKNVSVLEGLRQGRLGGPCSCHCPRPSQARLTPVDVAGPFLCLGDPGL
FPPVKSSITGGKSTCSAPGPQSLPSTPFSTYPQWVILITELGMECTLGQVGAPSPRREEDGWRGGHSRFKA
DVPAPQGPCWGGQPGSAPSSAPPEQSLLDDYWAQKEKISIPRTHLCLVLGVLSGHSGSRLWKFEMSYTVGG
PPPHVHARPRHWKTDR

The amino acid sequence of additional five neoantigen layouts for MVA expression are shown in SEQ ID NOs: 557, 558, 559, 625 and 626.

SEQ ID NO: 557

MGQKEQIHTLQKNSERMSKQLTRSSQAVQNLQNGGGSRSSATLPGRRRRRWLRRRRQPISVAPAGPPRRPN
QKPNPPGGARCVIMRPTWPGTSAFTGMECTLGQVGAPSPRREEDGWRGGHSRFKADVPAPQGPCWGGQPGS
APSSAPPEQSLLDDYWAQKEKISIPRTHLCWKFEMSYTVGGPPPHVHARPRHWKTDRDYWAQKEKGSSSFL
RPSCVPFRELKNVSVLEGLRQGRLGGPCSCHCPRPSQARLTPVDVAGPFLCLGDPGLFPPVKSSITEISCC
TLSSEENEYLPRPEWQLQYEAGMTLGGKILFFLFLLLPLSPFSLIFLVLGVLSGHSGSRLKRSFAVTERII
TGGKSTCSAPGPQSLPSTPFSTYPQWVILITELDGHSYTSKVNCLLLQDGFHGCVSITGAAGRRNLSIFLF
LMLCKLEFHACCHLFLQPQVGTPPPHTASARAPSGPPHPHESCPAGRRPARAAQTCARRQHGLPGCEEAGT
ARVPSLHLHLHQAALGAGRGRGWGEACAQVPPSRGHYKLIQQPISLFSITDRLHKTFSQLPSVHLCSITFQ
WGHPPIFCSTNDICVTANFCISVTFLKPCFLLHEASASQVAMMVPDRQVHYDFGLKIQNKNCPDVLRFLDL
KVRYLHSVPFRELKNQRTAQGAPGIHHAASPVAANLCDPARHAQHTRIPCGAGQVRAGRGPEAGGGVLQPQ
RPAPEKPGCPCRRGQPRLHTVKMWRAQWQHYHRSGEAAGTPLWRPTRNFKKFDGPCGERGGGRTARALWAR
GDSVLTPALDPQTPVRAPSLTRAAAAVGVPGDSTRRAVRRMNTFCGASACDVSLIAMDSACEERGAAGSLI
SCESLYHREKQLIAMDSAIFVQGKDWGVKKFIRRDFTMPAILKLQKNCLLSLNSKMALNSEALSVVSEYEA
GMTLGEKFRVGNCKHLKMTRPTEYNQKLQVNQFSESKRTALTHNQDFSIYRLCCKRGSLCHASQARSPAFP
KPVRPLPAPITRITPQLGGQSDSSQPLLTTGRPQGWQDQALRHTQQASPASCATITIPIHSAALGDHSGDP
GPAWDTCPPLPLTTLIPRAPPPYGDSTARSWPSRCGPLGYAYKDFLWCFPFSLVFLQEIQICCHVSCLCCI
CCSTRICLGCLLELFLSRALRALHVLWNGFQLHCQGNTTLQQLGEASQAPSGSLIPLRLPLLWEVRGNSKM
ALNSINSIDDAQLTRIAPPRSHCCFWEVNAPFVQGKDWGLKKFIRRDFEAFQRAAGEGGPGRGGARRGARV
LQSPFCRAGAGEWLGHQSLRWGMELAASRRFSWDHHSAGGPPRVPSVRSGAAQVQPKDPLPLRTLAGCLAR
TAHLRPGAESLPQPQLHCTIARELHQFAFDLLIKSHKMHFSLKEHPPPPCPPHVVGYGHLDTSGSSSSSSW
PQPDSFAALHSSLNELGELWFQSSELSPTGAPWPSRRPTWRGTTVSPRTATSSARTCCGTKWPSSQEAALG
LGSGLLRFSCGTAAIR

SEQ ID NO: 558

MGQKEQIHTLQKNSERMSKQLTRSSQAVDGHSYTSKVNCLLLQDGFHGCVSITGAAGRRNLSIFLFLMLCK
LEFHACQWQHYHRSGEAAGTPLWRPTRNVAMMVPDRQVHYDFGLVLRFLDLKVRYLHSKIQNKNCPDVPFR
ELKNQRTAQGAPGIHHAASPVAANLCDPARHAQHTRIPCGAGQVRAGRGPEAGGGVLQPQRPAPEKPGCPC
RRGQPRLHTVKMWRACHLFLQPQVGTPPPHTASARAPSGPPHPHESCPAGRRPARAAQTCARRQHGLPGCE
EAGTARVPSLHLHLHQAALGAGRGRGWGEACAQVPPSRGHYKLIQQPISLFSITDRLHKTFSQLPSVHLCS

-continued

ITFQWGHPPIFCSTNDICVTANFCISVTFLKPCFLLHEASASQFKKFDGPCGERGGGRTARALWARGDSVL
TPALDPQTPVRAPSLTRAAAAVQNLQNGGGSRSSATLPGRRRRRWLRRRRQPISVAPAGPPRRPNQKPNPP
GGARCVIMRPTWPGTSAFTGMECTLGQVGAPSPRREEDGWRGGHSRFKADVPAPQGPCWGGQPGSAPSSAP
PEQSLLDDYWAQKEKISIPRTHLCWKFEMSYTVGGPPPHVHARPRHWKTDRDYWAQKEKGSSSFLRPSCVP
FRELKNVSVLEGLRQGRLGGPCSCHCPRPSQARLTPVDVAGPFLCLGDPGLFPPVKSSITEISCCTLSSEE
NEYLPRPEWQLQYEAGMTLGGKILFFLFLLLPLSPFSLIFLVLGVLSGHSGSRLKRSFAVTERIITGGKST
CSAPGPQSLPSTPFSTYPQWVILITELGVPGDSTRRAVRRMNTFCGASACDVSLIAMDSACEERGAAGSLI
SCESLYHREKQLIAMDSAIFVQGKDWGVKKFIRRDFTMPAILKLQKNCLLSLNSKMALNSEALSVVSEYEA
GMTLGEKFRVGNCKHLKMTRPTEYNQKLQVNQFSESKRTALTHNQDFSIYRLCCKRGSLCHASQARSPAFP
KPVRPLPAPITRITPQLGGQSDSSQPLLTTGRPQGWQDQALRHTQQASPASCATITIPIHSAALGDHSGDP
GPAWDTCPPLPLTTLIPRAPPPYGDSTARSWPSRCGPLGYAYKDFLWCFPFSLVFLQEIQICCHVSCLCCI
CCSTRICLGCLLELFLSRALRALHVLWNGFQLHCQGNTTLQQLGEASQAPSGSLIPLRLPLLWEVRGNSKM
ALNSINSIDDAQLTRIAPPRSHCCFWEVNAPFVQGKDWGLKKFIRRDFEAFQRAAGEGGPGRGGARRGARV
LQSPFCRAGAGEWLGHQSLRWGMELAASRRFSWDHHSAGGPPRVPSVRSGAAQVQPKDPLPLRTLAGCLAR
TAHLRPGAESLPQPQLHCTIARELHQFAFDLLIKSHKMHFSLKEHPPPPCPPHVVGYGHLDTSGSSSSSSW
PQPDSFAALHSSLNELGELWFQSSELSPTGAPWPSRRPTWRGTTVSPRTATSSARTCCGTKWPSSQEAALG
LGSGLLRFSCGTAAIR

SEQ ID NO: 559

MGQKEQIHTLQKNSERMSKQLTRSSQAVGNTTLQQLGEASQAPSGSLIPLRLPLLWEVRGNSKMALNSLNS
IDDAQLTRIAPPRSHCCFWEVNAPFVQGKDWGLKKFIRRDFEAFQRAAGEGGPGRGGARRGARVLQSPFCR
AGAGEWLGHQSLRWGMELAASRRFSWDHHSAGGPPRVPSVRSGAAQVQPKDPLPLRTLAGCLARTAHLRPG
AESLPQPQLHCTIARELHQFAFDLLIKSHKMHFSLKEHPPPPCPPHVVGYGHLDTSGSSSSSSWPQPDSFA
ALHSSLNELGELWFQSSELSPTGAPWPSRRPTWRGTTVSPRTATSSARTCCGTKWPSSQEAALGLGSGLLR
FSCGTAAIRDGHSYTSKVNCLLLQDGFHGCVSITGAAGRRNLSIFLFLMLCKLEFHACQWQHYHRSGEAAG
TPLWRPTRNVAMMVPDRQVHYDFGLKIQNKNCPDVLRFLDLKVRYLHSVPFRELKNQRTAQGAPGIHHAAS
PVAANLCDPARHAQHTRIPCGAGQVRAGRGPEAGGGVLQPQRPAPEKPGCPCRRGQPRLHTVKMWRACHLF
LQPQVGTPPPHTASARAPSGPPHPHESCPAGRRPARAAQTCARRQHGLPGCEEAGTARVPSLHLHLHQAAL
GAGRGRGWGEACAQVPPSRGHYKLIQQPISLFSITDRLHKTFSQLPSVHLCSITFQWGHPPIFCSTNDICV
TANFCISVTFLKPCFLLHEASASQFKKFDGPCGERGGGRTARALWARGDSVLTPALDPQTPVRAPSLTRAA
AAVGVPGDSTRRAVRRMNTFCGASACDVSLIAMDSATEYNQKLQVNQFSESKYEAGMTLGEKFRVGNCKHL
KMTRPTMPAILKLQKNCLLSLNSKMALNSEALSVVSECEERGAAGSLISCESLYHREKQLIAMDSAIFVQG
KDWGVKKFIRRDFRTALTHNQDFSIYRLCCKRGSLCHASQARSPAFPKPVRPLPAPITRITPQLGGQSDSS
QPLLTTGRPQGWQDQALRHTQQASPASCATITIPIHSAALGDHSGDPGPAWDTCPPLPLTTLIPRAPPPYG
DSTARSWPSRCGPLGYAYKDFLWCFPFSLVFLQEIQICCHVSCLCCICCSTRICLGCLLELFLSRALRALH
VLWNGFQLHCQQNLQNGGGSRSSATLPGRRRRRWLRRRRQPISVAPAGPPRRPNQKPNPPGGARCVIMRPT
WPGTSAFTGMECTLGQVGAPSPRREEDGWRGGHSRFKADVPAPQGPCWGGQPGSAPSSAPPEQSLLDDYWA
QKEKISIPRTHLCWKFEMSYTVGGPPPHVHARPRHWKTDRDYWAQKEKGSSSFLRPSCVPFRELKNVSVLE
GLRQGRLGGPCSCHCPRPSQARLTPVDVAGPFLCLGDPGLFPPVKSSITEISCCTLSSEENEYLPRPEWQL
QYEAGMTLGGKILFFLFLLLPLSPFSLIFLVLGVLSGHSGSRLKRSFAVTERIITGGKSTCSAPGPQSLPS
TPFSTYPQWVILITEL

-continued

SEQ ID NO: 625

MGQKEQIHTLQKNSERMSKQLTRSSQAVGNTTLQQLGEASQAPSGSLIPLRLPLLWEVRGNSKMALNSLNS

IDDAQLTRIAPPRSHCCFWEVNAPFVQGKDWGLKKFIRRDFEAFQRAAGEGGPGRGGARRGARVLQSPFCR

AGAGEWLGHQSLRWGMELAASRRFSWDHHSAGGPPRVPSVRSGAAQVQPKDPLPLRTLAGCLARTAHLRPG

AESLPQPQLHCTIARELHQFAFDLLIKSHKMHFSLKEHPPPPCPPHVVGYGHLDTSGSSSSSSWPQPDSFA

ALHSSLNELGELWFQSSELSPTGAPWPSRRPTWRGTTVSPRTATSSARTCCGTKWPSSQEAALGLGSGLLR

FSCGTAAIRQNLQNGGGSRSSATLPGRRRRRWLRRRRQPISVAPAGPPRRPNQKPNPPGGARCVIMRPTWP

GTSAFTGMECTLGQVGAPSPRREEDGWRGGHSRFKADVPAPQGPCWGGQPGSAPSSAPPEQSLLDDYWAQK

EKISIPRTHLCWKFEMSYTVGGPPPHVHARPRHWKTDRDYWAQKEKGSSSFLRPSCVPFRELKNVSVLEGL

RQGRLGGPCSCHCPRPSQARLTPVDVAGPFLCLGDPGLFPPVKSSITEISCCTLSSEENEYLPRPEWQLQY

EAGMTLGGKILFFLFLLLPLSPFSLIFLVLGVLSGHSGSRLKRSFAVTERIITGGKSTCSAPGPQSLPSTP

FSTYPQWVILITELDGHSYTSKVNCLLLQDGFHGCVSITGAAGRRNLSIFLFLMLCKLEFHACQWQHYHRS

GEAAGTPLWRPTRNVAMMVPDRQVHYDFGLVLRFLDLKVRYLHSKIQNKNCPDVPFRELKNQRTAQGAPGI

HHAASPVAANLCDPARHAQHTRIPCGAGQVRAGRGPEAGGGVLQPQRPAPEKPGCPCRRGQPRLHTVKMWR

ACHLFLQPQVGTPPPHTASARAPSGPPHPHESCPAGRRPARAAQTCARRQHGLPGCEEAGTARVPSLHLHL

HQAALGAGRGRGWGEACAQVPPSRGHYKLIQQPISLFSITDRLHKTFSQLPSVHLCSITFQWGHPPIFCST

NDICVTANFCISVTFLKPCFLLHEASASQFKKFDGPCGERGGGRTARALWARGDSVLTPALDPQTPVRAPS

LTRAAAAVGVPGDSTRRAVRRMNTFCGASACDVSLIAMDSACEERGAAGSLISCESLYHREKQLIAMDSAI

FVQGKDWGVKKFIRRDFTMPAILKLQKNCLLSLNSKMALNSEALSVVSEYEAGMTLGEKFRVGNCKHLKMT

RPTEYNQKLQVNQFSESKRTALTHNQDFSIYRLCCKRGSLCHASQARSPAFPKPVRPLPAPITRITPQLGG

QSDSSQPLLTTGRPQGWQDQALRHTQQASPASCATITIPIHSAALGDHSGDPGPAWDTCPPLPLTTLIPRA

PPPYGDSTARSWPSRCGPLGYAYKDFLWCFPFSLVFLQEIQICCHVSCLCCICCSTRICLGCLLELFLSRA

LRALHVLWNGFQLHCQ

SEQ ID NO: 626

MGQKEQIHTLQKNSERMSKQLTRSSQAVDGHSYTSKVNCLLLQDGFHGCVSITGAAGRRNLSIFL

FLMLCKLEFHACVPFRELKNQRTAQGAPGIHHAASPVAANLCDPARHAQHTRIPCGAGQVRAGRG

PEAGGGVLQPQRPAPEKPGCPCRRGQPRLHTVKMWRAQWQHYHRSGEAAGTPLWRPTRNKIQNKN

CPDVAMMVPDRQVHYDFGLVLRFLDLKVRYLHSCHLFLQPQVGTPPPHTASARAPSGPPHPHESC

PAGRRPARAAQTCARRQHGLPGCEEAGTARVPSLHLHLHQAALGAGRGRGWGEACAQVPPSRGHY

KLIQQPISLFSITDRLHKTFSQLPSVHLCSITFQWGHPPIFCSTNDICVTANFCISVTFLKPCFL

LHEASASQFKKFDGPCGERGGGRTARALWARGDSVLTPALDPQTPVRAPSLTRAAAAVQNLQNGG

GSRSSATLPGRRRRRWLRRRRQPISVAPAGPPRRPNQKPNPPGGARCVIMRPTWPGTSAFTGMEC

TLGQVGAPSPRREEDGWRGGHSRFKADVPAPQGPCWGGQPGSAPSSAPPEQSLLDDYWAQKEKIS

IPRTHLCWKFEMSYTVGGPPPHVHARPRHWKTDRDYWAQKEKGSSSFLRPSCVPFRELKNVSVLE

GLRQGRLGGPCSCHCPRPSQARLTPVDVAGPFLCLGDPGLFPPVKSSITEISCCTLSSEENEYLP

RPEWQLQYEAGMTLGGKILFFLFLLLPLSPFSLIFLVLGVLSGHSGSRLKRSFAVTERIITGGKS

TCSAPGPQSLPSTPFSTYPQWVILITELGNTTLQQLGEASQAPSGSLIPLRLPLLWEVRGNSKMA

LNSLNSIDDAQLTRIAPPRSHCCFWEVNAPFVQGKDWGLKKFIRRDFEAFQRAAGEGGPGRGGAR

RGARVLQSPFCRAGAGEWLGHQSLRWGMELAASRRFSWDHHSAGGPPRVPSVRSGAAQVQPKDPL

PLRTLAGCLARTAHLRPGAESLPQPQLHCTIARELHQFAFDLLIKSHKMHFSLKEHPPPPCPPHV

VGYGHLDTSGSSSSSSWPQPDSFAALHSSLNELGELWFQSSELSPTGAPWPSRRPTWRGTTVSPR

-continued

TATSSARTCCGTKWPSSQEAALGLGSGLLRFSCGTAAIRGVPGDSTRRAVRRMNTFCGASACDVS

LIAMDSACEERGAAGSLISCESLYHREKQLIAMDSAIFVQGKDWGVKKFIRRDFYEAGMTLGEKF

RVGNCKHLKMTRPTMPAILKLQKNCLLSLNSKMALNSEALSVVSETEYNQKLQVNQFSESKRTAL

THNQDFSIYRLCCKRGSLCHASQARSPAFPKPVRPLPAPITRITPQLGGQSDSSQPLLTTGRPQG

WQDQALRHTQQASPASCATITIPIHSAALGDHSGDPGPAWDTCPPLPLTTLIPRAPPPYGDSTAR

SWPSRCGPLGYAYKDFLWCFPFSLVFLQEIQICCHVSCLCCICCSTRICLGCLLELFLSRALRAL

HVLWNGFQLHCQ

SEQ ID NO: 713 The polynucleotide sequence of the full GAd20 incorporating the GAd20 expression cassette catcatcaataatataccttattttggattgaggccaatatgataatgaggtgggcggggcgaggcggggc gggtgacgtaggacgcgcgagtagggttgggaggtgtggcggaagtgtggcatttgcaagtgggaggagct gacatgcaatcttccgtcgcggaaaatgtgacgtttttgatgagcgccgcctacctccggaagtgccaatt ttcgcgcgcttttcaccggatatcgtagtaattttgggcgggaccatgtaagatttggccattttcgcgcg aaaagtgaaacggggaagtgaaaactgaataatagggcgttagtcatagcgcgtaatatttaccgagggcc gagggactttgaccgattacgtggaggactcgcccaggtgtttttttacgtgaatttccgcgttccgggtca aagtctccgtttttattgtcgccgtcatctgacgggccgccattgcatacgttgtatccatatcataatat gtacatttatattggctcatgtccaacattaccgccatgttgacattgattattgactagttattaatagt aatcaattacggggtcattagttcatagcccatatatggagttccgcgttacataacttacggtaaatggc ccgcctggctgaccgcccaacgacccccgcccattgacgtcaataatgacgtatgttcccatagtaacgcc aatagggactttccattgacgtcaatgggtggagtatttacggtaaactgcccacttggcagtacatcaag tgtatcatatgccaagtacgccccctattgacgtcaatgacggtaaatggcccgcctggcattatgcccag tacatgaccttatgggactttcctacttggcagtacatctacgtattagtcatcgctattaccatggtgat gcggttttggcagtacatcaatgggcgtggatagcggtttgactcacggggatttccaagtctccacccca ttgacgtcaatgggagtttgttttggcaccaaaatcaacgggactttccaaaatgtcgtaacaactccgcc ccattgacgcaaatgggcggtaggcgtgtacggtgggaggtctatataagcagagctctccctatcagtga tagagatctccctatcagtgatagagatcgtcgacgagctcgtttagtgaaccgtcagatcgcctggagac gccatccacgctgttttgacctccatagaagacaccgggaccgatccagcctccgcggccgggaacggtgc attggaacgcggattccccgtgccaagagtgagatcttccgtttatctaggtaccagatatcagaattcgg atcccgcgacttcgccgccatgggccagaaagagcagatccacacactgcagaaaaacagcgagcggatga gcaagcagctgaccagatcttctcaggccgtgcagaacctgcagaacggcggaggctctagaagctctgct acacttcctggcaggcggcggagaagatggctgagaagaaggcggcagcctatctctgtggctcctgctgg acctcctagacggcccaaccagaagcctaatcctcctggcggagccagatgcgtgatcatgaggcctacat ggcctggcaccagcgccttcaccaagagaagctttgccgtgaccgagcggatcatcgactattgggctcaa aaagagaagggcagcagcagcttcctgcggcctagctgtgattattgggcccagaaagaaaagatcagcat ccccagaacacacctgtgcctggtgctgggagtgctgtctggacactctggcagcagactgtatgaggccg gcatgacactcggcggcaagatcctgttcttcctgttcctgctgctccctctgagccccttcagcctgatc ttcaccgagatcagctgctgcaccctgagcagcgaggaaaacgagtacctgcctagacctgagtggcagct gcaggtccccttcagagagctgaagaacgtttccgtgctggaaggcctgagacagggcagacttggcggcc cttgtagctgtcactgccccagacctagtcaggccagactgacacctgtggatgtggccggacctttcctg tgtctgggagatcctggcctgtttccacctgtgaagtccagcatcacaggcggcaagtccacatgttctgc -continued ccctggacctcagagcctgcctagcacacccttcagcacataccctcagtgggtcatcctgatcaccgaac tcggcatggaatgcaccctgggacaagtgggagccccatctcctagaagagaagaggatggctggcgcgga ggccactctagattcaaagctgatgtgcccgctcctcagggcccttgttggggaggacaacctggatctgc cccatcttctgccccacctgaacagtccctgctggattggaagttcgagatgagctacaccgtcggcggac ctccacctcatgttcatgccagacctcggcactggaaaaccgacagagatggccacagctacaccagcaaa gtgaactgcctcctgctgcaggatggcttccacggctgtgtgtctattactggcgccgctggcagacggaa cctgagcatctttctgtttctgatgctgtgcaagctcgagttccacgcctgcaagatccagaacaagaact gccccgacttcaagaagttcgacggcccttgcggagaaagaggcggaggcagaacagctagagccctttgg gctagaggcgacagcgttctgacaccagctctggaccctcagacacctgttagggcccctagcctgacaag agctgccgccgctgtgcactacaagctgatccagcagccaatcagcctgttcagcatcaccgaccggctgc acaagacattcagccagctgccaagcgtgcacctgtgctccatcaccttccagtggggacaccctcctatc ttttgctccaccaacgacatctgcgtgaccgccaacttctgtatcagcgtgaccttcctgaagccttgctt tctgctgcacgaggccagcgcctctcagtgccacttgtttctgcagccccaagtgggcacacctcctccac atacagcctctgctagagcacctagcggccctccacatcctcacgaatcttgtcctgccggaagaaggcct gccagagccgctcaaacatgtgccagacgacagcacggactgcctggatgtgaagaggctggaacagccag agtgcctagcctgcacctccatctgcatcaggctgctcttggagccggaagaggtagaggatggggcgaag cttgtgctcaggtgccaccttctagaggcgtgctgagattcctggacctgaaagtgcgctacctgcacagc cagtggcagcactatcacagatctggcgaagccgccggaacacccctttggaggccaacaagaaacgtgcc cttccgggaactgaagaaccagagaacagctcagggcgctcctggaatccaccatgctgcttctccagtgg ccgccaacctgtgtgatcctgccagacatgcccagcacaccaggattccttgtggcgctggacaagtgcgc gctggaagaggacctgaagcaggcggaggtgttctgcaacctcaaagacccgctcctgagaagcctggctg cccttgcagaagaggacagcctagactgcacaccgtgaaaatgtggcgagccgtggccatgatggtgcccg atagacaggtccactacgactttggactgggcgtgccaggcgatagcactcggagagccgtcagacggatg aacaccttttacgaagccgggatgaccctgggcgagaagttcagagtgggcaactgcaagcacctgaagat gacccggcctaacagcaagatggccctgaatagcgaggccctgtctgtggtgtctgaatgtggcgcctctg cctgtgacgtgtccctgatcgctatggactccgcctttgtgcagggcaaagactggggcgtgaagaagttc atccggcgggacttctacgcctacaaggacttcctgtggtgcttccccttctctctggtgttcctgcaaga gatccagatctgctgtcatgtgtcctgcctgtgctgcatctgctgtagcaccagaatctgcctgggctgtc tgctggaactgttcctgagcagagccctgagagcactgcacgtgctgtggaacggattccagctgcactgc cagaccgagtacaaccagaaactgcaagtgaaccagttcagcgagagcaagagcctgtaccaccgggaaaa gcagctcattgccatggacagcgccatctgcgaagagagaggcgccgcaggatctctgatctcctgcgaaa caatgcccgccatcctgaagctgcagaagaattgcctcctaagcctgcgaaccgctctgacacacaaccag gacttcagcatctacagactgtgttgcaagcggggctccctgtgccatgcaagccaagctagaagccccgc ctttcctaaacctgtgcgacctctgccagctccaatcaccagaattacccctcagctcggcggccagagcg attcatctcaacctctgctgaccaccggcagacctcaaggctggcaagaccaagctctgagacacacccag caggctagccctgcctcttgtgccaccatcacaatccccatccactctgccgctctgggcgatcattctgg cgatcctggaccagcctgggacacatgtcctccactgccactcacaacactgatccctagggctcctccac cttacggcgattctaccgctagaagctggcccagcagatgtggaccactcggaggcaacacaaccctccag caactgggagaagcctctcaggctcctagcggctctctgatccctctcagactgcctctcctgtgggaagt tcggggccagcctgattcttttgccgcactgcacagctccctgaacgagctgggagagatcgctagagagc -continued tgcaccagttcgccttcgacctgctgatcaagagccacttcgtgcaaggcaaggattggggcctcaaaaag tttatccgcagagacttctggggcatggaactggccgccagcagaagattcagctgggatcatcatagcgc aggcggcccacctagagtgccatctgttagaagcggagctgcccaggtgcagcctaaagatcctctgccac tgagaacactggccggctgccttgctagaacagcccatcttagacctggcgccgagtctctgcctcagcca caactgcactgtaccctgtggttccagtccagcgagctgtctcctactggtgccccttggccatctagacg ccctacttggagaggcaccaccgtgtcaccaagaaccgccacaagcagcgccagaacctgttgtggcacaa agtggccctccagccaagaagccgctctcggacttggaagcggactgctgaggttctcttgtggaaccgcc gccattcggaagatgcactttagcctgaaagaacaccctccaccaccttgtcctccagaggctttccaaag agctgctggcgaaggcggacctggtagaggtggtgctagaagaggtgctagggtgctgcagagcccattct gtagagcaggcgcaggcgaatggctgggccatcagagtctgagacatgtcgtcggctacggccacctggat acaagcggaagcagctctagctccagctggcctaactcaaaaatggctctgaacagcctgaactccatcga cgacgcccagctgacaagaatcgcccctcctagatctcactgctgcttttgggaagtgaacgccccaagcc atcaccatcaccaccattagtaaaggcgcgcctagcggccgcgatctgctgtgccttctagttgccagcca tctgttgtttgcccctcccccgtgccttccttgaccctggaaggtgccactcccactgtcctttcctaata aaatgaggaaattgcatcgcattgtctgagtaggtgtcattctattctggggggtggggtggggcaggaca gcaagggggaggattgggaagacaatagcaggcatgctggggatgcggtgggctctatggccgggccgcga tcgcgcttaggcctgaccatctggtgctggcctgcaccagggccgagtttgggtctagcgatgaggatacc gattgaggtgggtaaggtgggcgtggctagcagggtgggcgtgtataaattggggggtctaaggggtctctc tgtttgtcttgcaacagccgccgccatgagcgacaccggcaacagctttgatggaagcatctttagtccct atctgacagtgcgcatgcctcactgggccggagtgcgtcagaatgtgatgggttccaacgtggatggacgt cccgttctgccttcaaattcgtctactatggcctacgcgaccgtgggaggaactccgctggacgccgcgac ctccgccgccgcctccgccgccgccgcgaccgcgcgcagcatggctacggacctttacagctctttggtgg cgagcagcgcggcctctcgcgcgtctgctcgggatgagaaactgactgctctgctgcttaaactggaagac ttgacccgggagctgggtcaactgacccagcaggtttccagcttgcgtgagagcagccttgcctccccccta atggcccataatataaataaaagccagtctgtttggattaagcaagtgtatgttctttatttaactctccg cgcgcggtaagcccgggaccagcggtctcggtcgtttagggtgcggtggatttttttccaacacgtggtaca ggtggctctggatgtttagatacatgggcatgagtccatccctggggtggaggtagcaccactgcagagct tcgtgctcgggggtggtgttgtatatgatccagtcgtagcaggagcgctgggcgtggtgctgaaaaatgtc cttaagcaagaggcttatagctaggggggaggcccttggtgtaagtgtttacaaatctgcttagctgggagg ggtgcatccgggggggatatgatgtgcatcttggactggatttttaggttggctatgttcccgcccagatcc cttctgggattcatgttgtgcaggaccaccagcacggtatatccagtgcacttgggaaatttatcgtggag cttagacgggaatgcatggaagaacttggagacgcccttgtggcctcccagattttccatacattcgtcca tgatgatggcaatgggcccgtgggaagctgcctgagcaaaaacgtttctggcatcgctcacatcgtagtta tgttccagggtgaggtcatcataggacatctttacgaatcgggggcgaagggtcccggactgggggatgat ggtaccctcgggccccggggcgtagttcccctcacagatctgcatctcccaggctttcatttcagagggag ggatcatatccacctgcggggcgatgaaaaagacagtttctggcgcaggggagattaactgggatgagagc aggtttctgagcagctgtgactttccacagccggtgggcccatatatcacgcctatcaccggctgcagctg gtagttaagagagctgcagctgccgtcctcccggagcaggggggccacctcgttgagcatatccctgacgt ggatgttctccctgaccagttccgccagaaggcgctcgccgcccagcgaaagcagctcttgcaaggaagca aaatttttcagcggtttcaggccatcggccgtgggcatgtttttcagcgtctgggtcagcagctccagcct gtcccagagctcggtgatgtgctctacggcatctcgatccagcagatctcctcgtttcgcgggttggggcg -continued gctttcgctgtagggcaccagccgatgggcgtccagcggggccagagtcatgtccttccatgggcgcaggg tcctcgtcagggtggtctgggtcacggtgaaggggtgcgctccgggttgggcactggccagggtgcgcttg aggctggttctgctggtgctgaatcgctgccgctcttcgccctgcgcgtcggccaggtagcatttgaccat ggtctcgtagtcgagaccctcggcggcgtgccccttggcgcggagctttcccttggaggtggcgccgcacg aggggcactgcaggctcttcagggcgtagagcttgggagcgagaaacacggactctggggagtaggcgtcc gcgccgcaggccgagcagaccgtctcgcattccaccagccaagtgagttccgggcggtcagggtcaaaaac caggttgcccccatgctttttgatgcgtttcttaccttggctctccatgaggcggtgtcccttctcggtga cgaagaggctgtccgtgtccccgtagaccgacttcaggggcctgtcttccagcggagtgcctctgtcctcc tcgtagagaaactctgaccactctgagacgaaggcccgcgtccaggccaggacgaaggaggccacgtggga ggggtagcggtcgttgtccactagcgggtccaccttctccagggtgtgcaggcacatgtcccccctcctccg cgtccagaaaagtgattggcttgtaggtgtaggacacgtgaccgggggttcccaacgggggggtataaaag gggtgggtgccctttcatcttcactctcttccgcatcgctgtctgcgagagccagctgctggggtaagta ttccctctcgaaggcgggcatgacctcagcgctcaggttgtcagtttctaaaaatgaggaggatttgatgt tcacctgtccggaggtgatacctttgagggtacctgggtccatctggtcagaaaacactatttttttgtta tcaagcttggtggcgaatgacccgtagagggcgttggagagcagcttggcgatggagcgcagggtctggtt tttgtcgcggtcggctcgctccttggccgcgatgttgagttgcacgtactcgcgggccacgcacttccact cggggaacacggtggtgcgctcgtctgggatcaggcgcaccctccagccgcggttgtgcagggtgaccatg tcgacgctggtggcgacctcaccgcgcagacgctcgttggtccagcagaggcggccgcccttgcgcgagca gaagggggggtagggggtccagctggtcctcgtttgggggggtccgcgtcgatggtaaagaccccggggagca ggcgcgggtcaaagtagtcgatcttgcaagcttgcatgtccagagcccgctgccattcgcgggcggcgagc gcgcgctcgtaggggttgaggggcgggccccagggcatggggtgggtgagcgcggaggcgtacatgccgca gatgtcatacacgtacaggggttccctgaggataccgaggtaggtggggtagcagcgccccccgcggatgc tggcgcgcacgtagtcatagagctcgtgggagggggccagcatgttgggcccgaggttggtgcgctggggg cgctcggcgcggaagacgatctgcctgaagatggcgtgggagttggaggagatggtgggccgctggaagac gttgaagcttgcttcttgcaagcccacggagtccctgacgaaggaggcgtaggactcgcgcagcttgtgca ccagctcggcggtgacctggacgtcgagcgcacagtagtcgagggtctcgcggatgatgtcatacctatcc tccccctttctttttccacagctcgcggttgaggacgaactcttcgcggtctttccagtactcttggagggg aaacccgtccgtgtccgaacggtaagagcctagcatgtagaactggttgacggcctggtaggggcagcagc ccttctccacgggcagcgcgtaggcctgcgccgccttgcggagggaggtgtgggtgagggcgaaagtgtcc ctgaccatgactttgaggtattgatgtctgaagtctgtgtcatcgcagccgccctgttcccacagggtgta gtccgtgcgctttttggagcgcgggttgggcagggagaaggtgaggtcattgaagaggatcttccccgctc gaggcatgaagtttctggtgatgcgaaagggccctgggaccgaggagcggttgttgatgacctgggcggcc aggacgatctcgtcaaagccgtttatgttgtgtcccacgatgtagagctccaggaagcggggctggccctt gatggaggggagcttttttaagttcctcgtaggtaagctcctcgggcgattccaggccgtgctcctccaggg cccagtcttgcaagtgagggttggccgccaggaaggatcgccagaggtcgcgggccatgagggtctgcagg cggtcgcggaaggttctgaactgccgccccacggccatttttcgggggtgatgcagtagaaggtgagggg gtctttctcccaggggtcccatctgagctctcgggcgaggtcgcgcgcggcagcgaccagagcctcgtcgc cccccagtttcatgaccagcatgaagggcacgagttgcttgccaaaggctcccatccaagtgtaggtttct acatcgtaggtgacaaagaggcgctccgtgcgaggatgagagccgattgggaagaactggatctcccgcca ccagttggaggattggctgttgatgtggtgaaagtagaagtcccgtctgcgggccgagcactcgtgctggc -continued

```
ttttgtaaaagcgaccgcagtactggcagcgctgcacgggttgtatatcttgcacgaggtgaacctggcga
cctctgacgaggaagcgcagcgggaatctaagtcccccgcctggggtcccgtgtggctggtggtcttttac
tttggttgtctggccgccagcatctgtctcctggagggcgatggtggaacagaccaccacgccgcgagagc
cgcaggtccagatctcggcgctcggcgggcggagtttgatgacgacatcgcgcacattggagctgtccatg
gtctccagctcccgcggcggcaggtcagccgggagttccctggaggttcacctcgcagagacgggtcaagg
cgcggacagtgttgagatggtatctgatttcaaggggcatgttggaggcggagtcgatggcttgcaggagg
ccgcagcccccggggggccacgatggttccccgcggggcgcgaggggaggcggaagctgggggtgtgttcag
aagcggtgacgcgggcgggcccccggaggtaggggggggttccggccccacaggcatgggcggcaggggcac
gtcttcgccgcgcgcgggcaggggctggtgctggctccgaagagcgcttgcgtgcgcgacgacgcgacggt
tggtgttcctgtatctggcgcctctgagtgaagaccacgggtcccgtgaccttgaacctgaaagagagttc
gacagaatcaatctcggcatcgttgacagcggcctggcgcaggatctcctgcacgtcgcccgagttgtcct
ggtaggcgatttctgccatgaactgctcgatctcttcctcctggagatctcctcgtccggcgcgctccacg
gtggccgccaggtcgttggagatgcgacccatgagctgcgagaaggcgttgagtccgccctcgttccagac
ccggctgtagaccacgccccccctcggcgtcgcgggcgcgcatgaccacctgggccaggttgagctccacgt
gtcgcgtgaagacggcgtagttgcgcaggcgctggaaaaggtagttcagggtggtggcggtgtgctcggcg
acgaagaagtacatgacccagcgccgcaacgtggattcattgatgtcccccaaggcctccaggcgctccat
ggcctcgtagaagtccacggcgaagttgaaaaactgggagttgcgagcggacacggtcaactcctcctcca
gaagaacggatgagctcggcgacagtgtcgcgcacctcgcgctcgaaggccacgggggcgcttcttcctc
ttccacctcttcttccatgattgcttcttcttcttcctcagccgggacgggagggggcggcggcgggggag
gggcgcggcggcggcggcggcgcaccgggaggcggtcgatgaagcgctcgatcatctccccccgcatgcgg
cgcatggtctcggtgacggcgcggccgttctcccgggggcgcagctcgaagacgccgcctctcatttcgcc
gcggggcgggcggccgtgaggtagcgagacggcgctgactatgcatcttaacaattgctgtgtaggtacgc
cgccaagggacctgattgagtccagatccaccggatccgaaaacctttggaggaaagcgtctatccagtcg
cagtcgcaaggtaggctgagcaccgtggcgggcgggggcgggtcgggagagttcctggcggagatgctgct
gatgatgtaattaaagtaggcggtcttgagaaggcggatggtggacaggagcaccatgtctttgggtccgg
cctgttggatgcggaggcggtcggccatgccccaggcctcgttctgacaccggcgcaggtctttgtagtaa
tcttgcatgagtctttccaccggcacttcttctccttcctcttcttcatctcgccggtggtttctcgcgcc
gcccatgcgcgtgaccccaaagcccctgagcggctgcagcagggccaggtcggcgaccacgcgctcggcca
agatggcctgctgtacctgagtgagggtcctctcgaagtcatccatgtccacgaagcggtggtaggcaccc
gtgttgatggtgtaggtgcagttggccatgacggaccagttgacggtctggtgtcccggctgcgagagctc
cgtgtaccgcaggcgcgagaaggcgcgggaatcgaacacgtagtcgttgcaagtccgcaccagatactggt
agcccaccaggaagtgcggcggaggttggcgatagaggggccagcgctgggtggcgggggcgccgggcgcc
aggtcttccagcatgaggcggtggtatccgtagatgtacctggacatccaggtgatgcctgcggcggtggt
ggtggcgcgcgcgtagtcgcggacccggttccagatgtttcgcaggggcgagaagtgttccatggtcggca
cgctctggccggtgaggcgcgcgcagtcgttgacgctctatacacacacaaaaacgaaagcgtttacaggg
ctttcgttctgtagcctggaggaaagtaaatgggttgggttgcggtgtgccccggttcgagaccaagctga
gctcagccggctgaagccgcagctaacgtggtattggcagtcccgtctcgacccaggccctgtatcctcca
ggatacggtcgagagcccttttgctttcttggccaagcgcccgtggcgcgatctgggatagatggtcgcga
tgagaggacaaaagcggctcgcttccgtagtctggagaaacaatcgccagggttgcgttgcggcgtacccc
ggttcgagcccctatggcggcttggatcggccggaaccgcggctaacgtgggctgtggcagccccgtcctc
aggaccccgccagccgacttctccagttacgggagcgagccccttttgtttttttatttttttagatgcatc
```

Figure 10:
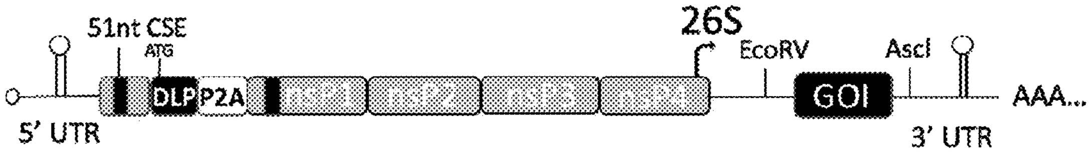
FIG. 10 is a schematic illustration of an exemplary srRNA derived from an alphavirus that contains a 5'-cap, nonstructural genes (NSP1-4), 26S subgenomic promoter (grey arrow), the gene of interest (GOI), and a 3'-polyadenylated tail. The illustration also shows the 2A ribosome skipping element (2AP) and the duplicated first 193 nucleotides of nsP1 downstream of the 5'-UTR and upstream of the DLP except for the start codon

-continued ccgtgctgcggcagatgcgcccctcgccccggcccgatcagcagcagcaacagcaggcatgcagaccccccc tctcctctccccgccccggtcaccacggccgcggcggccgtgtccggtgcgggggcgcgctggagtcaga tgagccaccgcggcggcgacctaggcagtatctggacttggaagagggcgagggactggcgcggctggggg cgagctctccagagcgccacccgcgggtgcagttgaaaagggacgcgcgtgaggcgtacctgccgcggcaa aacctgtttcgcgaccgcgggggcgaggagcccgaggagatgcgggactgcaggttccaagcggggcgcga gctgcgccgcggcttggacagacagcgcctgctgcgcgaggaggactttgagcccgacacgcagacgggca tcagccccgcgcgcgcgcacgtggccgcggccgacctggtgaccgcctacgagcagacggtgaaccaggag cgcaacttccaaaaaagcttcaacaaccacgtgcgcacgctggtggcgcgcgaggaggtgaccctgggtct catgcatctgtgggacctggtggaggcgatcgtgcagaaccccagcagcaagcccctgaccgcgcagctgt tcctggtggtgcagcacagcagggacaacgaggccttcagggaggcgctgctgaacatcaccgagccggag gggcgctggctcctggacctgataaacatcctgcagagcatagtggtgcaggagcgcagcctgagcctggc cgagaaggtggcggccattaactattctatgctgagcctgggcaagttctacgctcgcaagatctacaaga ccccctacgtgcccatagacaaggaggtgaagatagacagcttctacatgcgcatggcgctgaaggtgcta accctgagcgacgacctgggagtgtaccgcaacgagcgcatccacaaggccgtgagcgccagccggcggcg cgagctgagcgaccgcgaactgatgcacagtctgcagcgcgcgctgaccggcgcgggcgagggcgacaggg aggtcgagtcctactttgacatgggggccgacctgcactggcagccgagccgccgcgccctggaagcggcg gggcgtacggcggcccccctggcggccgatgacgaggaagaggaggactatgagctagaggagggcgagta cctggaggactgacctggctggtggtgttttggtatagatgcaagatccgaacgtggcggacccggcggtc cgggcggcgctgcagagccagccgtccggcattaactcctctgacgactgggccgcggccatgggtcgcat catggccctgaccgcgcgcaaccccgaggccttcaggcagcagcctcaggctaaccggctggcggccatct tggaagcggtagtgcccgcgcgctccaaccccacccacgagaaggtgctggccatagtcaacgcgctggcg gagagcagggccatccgggcagacgaggccggactggtgtacgatgcgctgctgcagcgggtggcgcggta caacagcggcaacgtgcagaccaacctggaccgcctggtgacggacgtgcgcgaggccgtggcgcagcgcg agcgcttgcatcaggacggcaacctgggctcgctggtggcgctaaacgccttccttagcacccagccggcc aacgtaccgcgggggcaggaggactacaccaacttcttgagcgcgctgcggctgatggtgaccgaggtccc tcagagcgaggtgtaccagtcggggcccgactacttcttccagaccagcagacagggcttgcaaaccgtga acctgagccaggctttcaagaacctgcgggggctgtggggagtgaaggcgcccaccggcgaccgggctacg gtgtccagcctgctaaccccaactcgcgcctgctgctgctgctgatcgcgcccttcacggacagcgggag cgtctcgcgggagacctatctgggccacctgctgacgctgtaccgcgaggccatcgggcaggcgcaggtgg acgagcacaccttccaggagatcaccagcgtgagccacgcgctggggcaggaggacacgggcagcctgcag gcgaccctgaactacctgctgaccaacaggcggcagaagattcccacgctgcacagcctgacccaggagga ggagcgcatcttgcgctacgtgcagcagagcgtgagcctgaacctgatgcgcgacggcgtgacgcccagcg tggcgctggacatgaccgcgcgcaacatggaaccgggcatgtacgcttcccagcggccgttcatcaaccgc ctgatggactacttgcatcgggcggcggccgtgaaccccgagtacttcaccaatgccattctgaatcccca ctggatgcccccctccgggtttctacaacggggacttcgaggtgcctgaggtcaacgatgggttcctctggg atgacatggatgacagtgtgttctcccccaacccgctgcgcgccgcgtctctgcgattgaaggagggctct gacagggaaggaccaaggagtctggcctcctccctggctctgggggcggtgggcgccacgggcgcggcggc gcggggcagcagccccttccccagcctggcggactctctgaatagcgggcgggtgagcaggccccgcttgc taggcgaggaggagtatctgaacaactccctgctgcagcccgtgagggacaaaaacgctcagcggcagcag tttcccaacaatgggatagagagcctggtggacaagatgtccagatggaagacgtatgcgcaggagtacaa -continued ggagtgggaggaccgccagccgcggcccctgccgcccccctagacagcgctggcagcggcgcgcgtccaacc gccgctggaggcaggggcccgaggacgatgatgactctgcagatgacagcagcgtgttggacctgggcggg agcgggaacccccttttcgcacctgcgcccacgcctgggcaagatgttttaaaagagaaaaataaaaactca ccaaggccatggcgacgagcgttggtttttttgttcccttccttagtatgcggcgcgcggcgatgttcgagg aggggcctcccccctcttacgagagcgcgatgggaatttctcctgcggcgcccctgcagcctccctacgtg cctcctcggtacctgcaacctacagggggggagaaatagcatctgttactctgagctgcagcccctgtacga taccaccagactgtacctggtggacaacaagtccgcggacgtggcctccctgaactaccagaacgaccaca gcgatttttttgaccacggtgatccaaaacaacgacttcaccccaaccgaggccagtacccagaccataaac ctggacaacaggtcgaactggggcggcgacctgaagactatcctgcacaccaatatgcccaacgtgaacga gttcatgttcaccaactcttttaaggcgcgggtgatggtggcgcgcgagcaggggggaggcgaagtacgagt gggtggacttcacgctgcccgagggcaactactcagagaccatgactctcgacctgatgaacaatgcgatc gtggaacactatctgaaagtgggcaggcagaacggggtgaaggagagcgatatcggggtcaagtttgacac cagaaacttccgtctgggctgggaccctgtgaccgggctggtcatgccgggggtctacaccaacgaggcct ttcatcccgatatagtgctcctgcccggctgtggggtggacttcacccagagccggctgagcaacctgctg ggcgttcgcaagcggcaacctttccaggagggtttcaagatcacctatgaggatctggagggggggcaacat tcccgcgctccttgatctggacgcctacgaggagagcttgaaacccgaggagagcgctggcgacagcggcg agagtggcgaggagcaagccggcggcggcggcagcgcgtcggtagaaaacgaaagtactcccgcagtggcg gcggacgctgcggaggtcgagccggaggccatgcagcaggacgcagaggagggcgcgcaggaggacatgaa caatggggagatcaggggcgacactttcgccacccggggcgaagaaaaagaggcagaggcggcggcggcga cggcggaagccgaaaccgaggcagaggcagagcccgagaccgaagttatggaagacatgaatgatggagaa cgtaggggtgacacgtttgccacccggggcgaagagaaggcggcggaggcagaagccgcggctgaggaggc ggctgcggctgcggccaaggctgaggctgcggctgaggctaaggtcgaagccgatgttgcggttgaggctc aggctgaggaggaggcggcggctgaagcagttaaggaaaaggcccaggcagagcaggaagagaaaaaacct gtcattcaacctctaaaagaagatagcaaaaagcgcagttacaacgtcattgagggcagcacctttaccca ataccgcagctggtacctggcttacaactacggcgacccggtcaaggggggtgcgctcgtggaccctgctct gcacgccggacgtcacctgcggctccgagcagatgtactggtcgctgccaaacatgatgcaagacccggtg accttccgttccacgcggcaggttagcaactttccggtggtgggcgccgaactgctgccagtacactccaa gagtttttacaacgagcaggccgtctactcccagctgatccgccaggccacctctctgacccacgtgttca atcgctttcccgagaaccagattttggcgcgcccgccggccccccaccatcaccaccgtcagtgaaaacgtt cctgccctcacagatcacgggacgctaccgctgcgcaacagcatctcaggagtccagcgagtgaccattac tgacgccagacgccggacctgcccctacgtttacaaggccttgggcatagtctcgccgcgcgtcctctcca gtcgcactttttaaaacacatccacccacacgctccaaaatcatgtccgtactcatctcgcccagcaacaa caccggctgggggctgcgcgcacccagcaagatgtttggaggggcaaggaagcgctccgaccagcaccccg tgcgcgtgcgcggccactaccgcgcgccctggggtgcgcacaagcgcgggcgcacagggcgcaccactgtg gatgatgtcattgactccgtagtggagcaggcgcgccactacacacccggcgcgccgaccgcctccgccgt gtccaccgtggaccaggcgatcgaaagcgtggtacagggggcgcggcactatgccaaccttaaaagtcgcc gccgccgcgtggcgcgccgccatcgccggagaccccgggctactgccgccgcgcgccttaccaaggctctg ctcaagcgcgccaggcgaactggccaccgggccgccatgagggccgcacggcgggctgccgctgccgcgag cgccgtggccccgcgggcacgaaggcgcgcggccgctgccgccgccgccgccatttccagcttggcctcga cgcggcgcggtaacatatactgggtgcgcgactcggtgagcggcacacgtgtgcccgtgcgctttcgcccc ccacggaattagcacaagacaacatacacactgagtctcctgctgttgtgtatcccagcggcgaccgtcag -continued cagcggcgacatgtccaagcgcaaaattaaagaagagatgctccaggtcatcgcgccggagatctatgggc
ccccgaagaaggaggaggaggattacaagccccgcaagctaaagcgggtcaaaaagaaaaagaaagatgat
gacgttgacgaggcggtggagtttgtccgccgcatggcgcccaggcgccctgtgcagtggaagggtcggcg
cgtgcagcgagtcctgcgccccggcaccgcggtggtctttacgcccggcgagcgttccacgcgcactttca
agcgggtgtacgatgaggtgtacggcgacgaggatctgttggagcaggccaaccatcgatttggggagttt
gcatatgggaaacggcctcgcgagagtctaaaagaggacctgctggcgctaccgctggacgagggcaatcc
caccccgagtctgaagccggtgaccctgcaacaggtgctgcctttgagcgcgcccagcgagcagaagcgag
ggttaaagcgcgagggcggggacctggcacccaccgtgcagttgatggtgcccaagcggcagaagctggag
gacgtgctggagaaaatgaaagtagagcccgggatccagcccgagatcaaggtccgccctatcaagcaggt
ggcgcccggcgtgggagtccagaccgtggacgttaggattcccacggaggagatggaaacccaaaccgcca
ctccctcttcggcagcaagcgccaccaccggcgccgcttcggtagaggtgcagacggacccctggctaccc
gccgccactatcgccgtcgccgccgcccccgttcgcgcggacgcaagagaaattatccagcggccagcgc
gcttatgccccagtatgcgctgcatccatccatcgcgcccacccccggctaccgcgggtactcgtaccgcc
cgcgcagatcagccggcactcgcggccgccgccgccgtgcgaccacaaccagccgccgccgtcgccgccgc
cgccagccagtgctgacccccgtgtctgtaaggaaggtggctcgctcggggagcacgctggtggtgcccag
agcgcgctaccaccccagcatcgtttaaagccggtctctgtatggttcttgcagatatggccctcacttgt
cgccttcgcttcccggtgccgggataccgaggaagaactcaccgccgcaggggcatggcgggcagcggtct
ccgcggcggccgtcgccatcgccggcgcgcaaagagcaggcgcatgcgcggcggtgtgttgcccctgctgg
tcccgctactcgccgcggcgatcggcgccgtgcccgggatcgcctccgtggccctgcaggcgtcccagaaa
cattgactcttgcaaccttgcaagcttgcatttttggaggaaaaaataaaaaagtctagactctcacgctc
gcttggtcctgtgactattttgtagaaaaaagatggaagacatcaactttgcgtcgctggccccgcgtcac
ggctcgcgcccgttcatgggagactggacagatatcggcaccagcaatatgagcggtggcgccttcagctg
gggcagtctgtggagcggccttaaaaattttggttccaccattaagaactatggcaacaaagcgtggaaca
gcagcacgggtcagatgctgagagacaagttgaaagagcagaacttccaggagaaggtggcgcagggcctg
gcctctggcatcagcggggtggtggacatagctaaccaggccgtgcagaaaaagataaacagtcatctgga
cccccgccctcaggtggaggaaacgcctccagccatggagacggtgtctcccgagggcaaaggcgaaaagc
gcccgcggcccgacagggaagagaccctggtgtcacacaccgaggagccgccctcttacgaggaggcagtc
aaggccggcctgcccaccactcgccccatagctcccatggccaccggtgtggtgggtcacaggcaacacac
ccccgcaacactagatctgcccccgccgtccgagccgactcgccagccaaaggcggtgacggtgtccgctc
cctccacttccgccgccaacagagtgcctctgcgccgcgctgcgagcggcccccgggcctcgcgagtcagc
ggcaactggcagagcacactgaacagcatcgtgggcctgggagtgaggagtgtgaagcgccgccgttgcta
ctgaatgagcaagctagctaacgtgttgtatgtgtgtatgcgtcctatgtcgccgccagaggagctgttga
gccgccggcgccgtctgcactccagcgaatttcaagatggcgaccccatcgatgatgcctcagtggtcgta
catgcacatctcgggccaggacgcttcggagtacctgagccccgggctggtgcagttcgcccgcgccacag
acacctacttcaacatgagtaacaagttcaggaaccccactgtggcgcccacccacgatgtgaccacggac
cggtcgcagcgcctgacgctgcggttcatccccgtggatcgggaggacaccgcttactcttacaaggcgcg
gttcacgctggccgtgggcgacaaccgcgtgctggacatggcctccacttactttgacatccgggggggtgc
tggacaggggcccccacttttaagccctactcgggcactgcctacaacccccctggcccccaagggcgccccc
aattcttgtgagtgggaacaagaggaaaatcaggtggtcgctgcagatgatgaacttgaagatgaagaagc
gcaagcacaagaggaagcccctgtgaaaaaaattcatgtatatgctcaggcgcctctttctggcgaaaaga -continued tttccaaggatggtatccaaataggtactgaagtcgtaggagatacatctaaggacacttttgcagataaa acattccaacccgaacctcagataggcgagtctcagtggaacgaggctgatgccacagcagcaggaggtag agttttgaaaaagactacccctatgagaccttgctatggatcctatgccaggcctaccaatgccaacgggg gtcaaggaattatggttgccaatgaacaaggagtgttggagtctaaagtagaaatgcaatttttctctaac accacaacccttaatgcgcgggatggaaccggcaatcccgaaccaaaggtggtgttgtacagcgaagatgt ccacttggaatctcccgatactcatctgtcttacaagcccaaaaaggatgatgttaatgccaaaatcatgt tgggtcagcaagccatgcccaacagacccaacctcattggatttagagataatttcattgggcttatgttt tacaacagcaccggtaacatgggagtgctggcgggtcaggcctctcagttgaatgctgtggtggacttgca ggatagaaacacagaactgtcatatcagcttctgcttgattcaattggggatagaaccagatacttctcca tgtggaaccaggcagtggatagctatgatccagatgtcagaattattgaaaaccatgggactgaggatgaa ctgcccaactactgcttccctttgggcggcataggagttactgatacttatcaagggataaaaaataccaa tggcaatggtcagtggaccaaagatgatcagttcgcggaccgcaacgaaataggggtgggaaacaacttcg ccatggagatcaacatccaggccaacctttggagaaacttcctctatgcaaacgtggggctctacctgcca gacaagctcaagtacaaccccaccaacgtggacatctctgacaaccccaacacctatgactacatgaacaa gcgggtggtggcccctggcctggtggactgctttgtcaatgtgggagccaggtggtccctggactacatgg acaacgtcaaccccttcaaccaccaccgcaatgcgggtctgcgctaccgctccatgatcctgggcaacggg cgctatgtgccctttcacatccaggtaccccagaagttctttgccatcaagaacctcctgctcctgcccgg ctcctacacctacgagtggaacttcaggaaggatgtgaacatggtcctacagagctctctgggcaatgacc ttagggtggatggggccagcatcaagtttgacagcatcaccctctatgctacatttttccccatggcccac aacaccgcctccacgcttgaggccatgctgagaaacgacaccaacgaccagtcctttaatgactacctctc tggggccaacatgctctacccaatcccagccaaggccaccaacgtgcccatctccatcccctctcgcaact gggccgcctttagaggctgggcctttacccgccttaagaccaaggagacccccctccctgggctcgggtttt gatccctactttgtttactcgggatccatcccctacctggatggcaccttctacctcaaccacactttcaa gaagatatccatcatgtatgactcctccgtcagctggccgggcaacgaccgcttgctcacccccaatgagt tcgaggtcaagcgcgccgtggacggcgagggctacaacgtggcccagtgcaacatgaccaaggactggttc ctggtgcagatgctggccaactacaacataggctaccagggcttttacatcccagagagctacaaggacag gatgtactccttcttcagaaatttccaacccatgagccgacaggtggtggacgagaccaattacaaggact atcaagccattggcatcacccaccagcacaacaactcgggtttcgtgggctacctggcgcccaccatgcgc gagggtcaggcctaccccgccaacttcccctaccccttgataggcaagaccgcggtcgacagcgtcaccca gaaaaagttcctctgcgaccgcaccctctggcgcatccccttctctagcaacttcatgtccatgggtgcgc tcacggacctgggccaaaacctgctttatgccaactctgcccatgcgctggacatgacttttgaggtggac cccatggacgagcccacccttctctatattgtgtttgaagtgttcgacgtggtcagagtgcaccagccgca ccgcggtgtcatcgagaccgtgtacctgcgtacgcccttctcagccggcaacgccaccacctaaggagaca gcgccgccgccgcctgcatgacgggttccaccgagcaagagctcagggccattgccagagacctgggatgc ggaccctatttttgggcacctatgacaaacgcttcccgggctttatctcccgagacaagctcgcctgcgc cattgtcaacacggccgcgcgcgagaccgggggcgtgcactggctggcctttggctgggacccgcgctcca aaacttgctacctctttgacccctttggcttctccgatcagcgcctcaggcagatttatgagtttgagtac gaggggctgctgcgccgcagcgcgctcgcctcctcgcccgaccgctgcatcacccttgagaagtccaccga aaccgtgcaggggccccactcggccgcctgcggtctcttctgttgcatgtttttgcacgcctttgtgcact ggcctcagagtcccatggattgcaaccccaccatgaacttgctaaagggagtgcccaacgccatgctccag agcccccaggtccagcccaccctgcgccgcaaccaggaacagctttaccgcttcctggagcgccactcccc -continued ctacttccgcagccacagcgcgcgcatccggggggccacctctttttgccacttgcaagaaaacatgcaag acggaaaatgatgtacagcatgcttttaataaatgtaaagactgtgcactttaattatacacgggctcttt ctggttatttattcaacaccgccgtcgccatttagaaatcgaaagggttctgccgtgcgtcgccgtgcgcc acgggcagagacacgttgcgatactggaagcggctcgcccacttgaactcgggcaccaccatgcggggcag tggttcctcggggaagttctcgctccacagggtgcgggtcagctgcagcgcgctcaggaggtcgggagccg agatcttgaagtcgcagttggggccggaaccctgcgcgcgcgagttgcggtacacggggttgcagcactgg aacaccagcagggccggattattcacgctggccagcaggctctcgtcgctgatcatgtcgctgtccagatc ctccgcgttgctcagggcgaatggggtcatcttgcagacctgcctgcccaggaaaggcgggagcccaggct tgccgttgcagtcgcagcgcaggggcattagcaggtgcccacggcccgactgcgcctgcgggtacaacgcg cgcatgaaggcttcgatctgcctaaaagccacctgggtcttggctccctccgaaaagaacatcccacagga cttgctggagaactggttcgcgggacagctggcatcgtgcaggcagcagcgcgcgtcagtgttggcaatct gcaccacgttgcgaccccaccggtttttcactatcttggccttggaagcctgctcctttagcgcgcgctgg ccgttctcgctggtcacatccatctctatcacctgttccttgttgatcatgtttgtcccgtgcagacactt taggtcgccctccgtctgggtgcagcggtgctcccacagcgcgcaaccggtgggctcccaattcttgtggg tcacccccgcgtaggcctgcaggtaggcctgcaggaagcgccccatcatggtcataaaggtcttctggctc gtaaaggtcagctgcaggccgcgatgctcttcgttcagccaggtcttgcagatggcggccagcgcctcggt ctgctcgggcagcatcttaaaatttgtcttcaggtcgttatccacgtggtacttgtccatcatggcacgcg ccgcctccatgcccttctcccaggcggacaccatgggcaggcttagggggtttatcacttccagcggcgag gacaccgtactttcgatttcttcttcctcccccctcttcccggcgcgcgcccccgctgttgcgcgctcttac cgcctgcaccaaggggtcgtcttcaggcaagcgccgcaccgagcgcttgccgcccttgacctgcttgatca gtaccggcgggttgctgaagcccaccatggtcagcgccgcctgctcttcttcgtcttcgctgtctaccact atttctggggaggggcttctccgctctgcggcaaaggcggcggatcgcttctttttttttcttgggagccgc cgcgatggagtccgccacggcgaccgaggtcgagggcgtggggctgggggtgcgcggtaccagggcctcgt cgccctcggactcttcctctgactccaggcggcggcggagtcgcttctttgggggcgcgcgcgtcagcggc ggcggagacggggacggggacggggacgggacgccctccacagggggtggtcttcgcgcagacccgcggcc gcgctcgggggtcttctcgcgctggtcttggtcccgactggccattgtatcctcctcctcctaggcagaga gacataaggagtctatcatgcaagtcgagaaggaggagagcttaaccacccccctcagagaccgccgatgcg cccgccgtcgccgtcgcccccgctaccgccgacgcgcccgccacaccgagcgacacccccacggaccccc cgccgacgcacccctgttcgaggaagcggccgtggagcaggacccgggctttgtctcggcagaggaggatt tgcaagaggaggagaataaggaggagaagccctcagtgccaaaagatcataaagagcaagacgagcacgac gcagacgcacaccagggtgaagtcgggcgggggggacggagggcatggcggcgccgactacctagacgaagg aaacgacgtgctcttgaagcacctgcatcgtcagtgcgccatcgtctgcgacgctctgcaggagcgcagcg aggtgcccctcagcgtggcggaggtcagccgcgcctacgagctcagcctcttttcccccgggtgccccc cgccgccgcgaaaacggcacatgcgagcccaacccgcgcctcaacttctaccccgcctttgtggtgcccga ggtcctggccacctatcacatcttctttcaaaattgcaagatccccatctcgtgccgcgccaaccgtagcc gcgccgataagatgctggccctgcgccagggcgaccacatacctgatatcgccgctttggaagatgtgcca aagatcttcgagggtctggggcgcaacgagaagcgggcagcaaactctctgcaacaggaaaacagcgaaaa tgagagtcacactggagcgctggtggagctggagggcgacaacgcccgcctggcggtgctcaagcgcagca tcgaggtcacccactttgcctaccccgcgctcaacctgccccccaaagtcatgaacgcggtcatggacggg ctgatcatgcgccgcggccggcccctcgctccagatgcaaacttgcatgaggagaccgaggacggtcagcc -continued cgtggtcagcgacgagcagctgacgcgctggctggagagcgcggaccccgccgaactggaggagcggcgca agatgatgatggccgcggtgctggtcaccgtagagctggagtgtctgcagcgcttcttcggtgaccccgag atgcagagaaaggtcgaggagaccctacactacaccttccgccagggctacgtgcgccaggcttgcaagat ctccaacgtggagctcagcaacctggtgtcctacctgggcatcttgcatgaaaaccgccttgggcagagcg tgctacactccaccctgcgcggggaggcgcgccgcgactacgtgcgcgactgcgtttacctcttcctctgc tacacctggcagacggccatgggggtctggcagcagtgcctggaggagcgcaacctcaaggagctggagaa gcttctgcagcgcgcgctcaaagacctctggacgggcttcaacgagcgctcggtggccgccgcgctagccg acctcatcttccccgagcgcctgctcaaaaccctccagcaggggctgcccgacttcaccagccaaagcatg ttgcaaaattttaggaactttatcctggagcgttctggcatcctacccgccacctgctgcgccctgcccag cgactttgtcccccctcgtgtaccgcgagtgccccccgccgctgtggggccactgctacctgttccaactgg ccaactacctgtcctaccacgcggacctcatggaggactccagcggcgaggggctcatggagtgccactgc cgctgcaacctctgcacgccccaccgctccctggtctgcaacacccaactgctcagcgagagtcagattat cggtaccttcgagctacagggtccgtcctcctcagacgagaagtccgcggctccggggctaaaactcactc cggggctgtggacttccgcctacctgcgcaaatttgtacctgaagactaccacgcccacgaaatcaggttt tacgaggaccaatcccgcccgcccaaggcggagctgaccgcctgcgtcatcacccagggcgagatcctagg ccaattgcaagccatccaaaaagcccgccaagagtttttgctgaagaggggtcggggggtgtatctggacc cccagtcgggtgaggagctcaacccggttcccccgctgccaccgccgcgggaccttgcttcccaggataag catcgccatggctcccagaaagaagcagcagcggccgccgctgccgccgccccacatgctggaggaagagg aggaatactgggacagtcaggcagaggaggtttcggacgaggaggagccggagacggagatggaagagtgg gaggaggacagcttagacgaggaggcttccgaagccgaagaggcaggcgcaacaccgtcaccctcggccgc agcccccctcgcaggcgcccccgaagtccgctcccagcatcagcagcaacagcagcgctataacctccgctc ctccaccgccgcgacccacggccgaccgcagacccaaccgtagatgggacaccaccggaaccggggccggt aagtcctccgggagaggcaagcaagcgcagcgccaaggctaccgctcgtggcgcgctcacaagaacgccat agtcgcttgcttgcaagactgcgggggggaacatctccttcgcccgccgcttcctgctcttccaccacggtg tggccttccccgtaacgtcctgcattactaccgtcatctctacagcccctactgcggcggcagtgagcca gaggcggccagcggcggcggcgcccgtttcggtgcctaggaagacccagggcaagacttcagccaagaaac tcgcggcgaccgcggcgaacgcggtcgcgggggccctgcgcctgacggtgaacgaacccctgtcgacccgc gaactgaggaaccgaatcttccccactctctatgccatcttccagcagagcagagggcaggatcaggaact gaaagtaaaaaacaggtctctgcgctccctcacccgcagctgtctgtatcacaagagcgaagaccagcttc ggcgcacgctggaggacgctgaggcactcttcagcaaatactgcgcgctcactcttaaggactagctccgc gcccttctcgaatttaggcgggaacgcctacgtcatcgcagcgccgccgtcatgagcaaggacattcccac gccatacatgtggagctatcagccgcagatgggactcgcggcgggcgcctcccaagactactccacccgca tgaactggctcagtgccggcccacacatgatctcacaggttaatgacatccgcacccatcgaaaccaaata ttggtgaagcaggcggcaattaccaccacgccccgcaataatcccaaccccagggagtggcccgcgtccct ggtgtatcaggaaattcccggccccaccaccgtactacttccgcgtgattcccaggccgaagtccaaatga ctaactcaggggcacagctcgcgggcggctgtcgtcacagggtgcggcctcctcgccagggtataactcac ctggagatccgaggcagaggtattcagctcaacgacgagtcggtgagctcctcgctcggtctcagacctga cgggaccttccagatagccggagccggccgatcttccttcacgccccgccaggcgtacctgactctgcaga gctcgtcctcggcgccgcgctcgggcggcatcgggactctccagttcgtgcaggagtttgtgccctcggtc tacttcaaccccttctcgggctctcccggtcgctacccggaccagtttatcccgaactttgacgccgcgag ggactcggtggacggctacgactgaatgtcgggtggacccggtgcagagcaacttcgcctgaagcaccttg -continued accactgccgccgccctcagtgctttgcccgctgtcagaccggtgagttccagtacttttccctgcccgac
tcgcacccggacggcccggcgcacggggtgcgctttttcatcccgagtcaggtccgctctaccctaatcag
ggagttcaccgcccgtcccctactggcggagttggaaaaggggccttctatcctaaccattgcctgcattt
gctctaaccctggattacaccaagatctttgctgtcatttgtgtgctgagtataataaaggctgagatcag
aatctactcggaccttatccctttcaattgatcataactgtaatcaataaaaaatcacttacttgaaatct
gatagcaagactctgtccaatttttttcagcaacacttccttcccctcctcccaactctggtactctaggcg
cctcctagctgcaaacttcctccacagtctgaagggaatgtcagattcctcctcctgtccctccgcaccca
cgatcttcatgttgttacagatgaaacgcgcgagatcgtctgacgagaccttcaaccccgtgtacccctac
gataccgagatcgctccgacttctgtccctttccttacccctccctttgtatcatccgcaggaatgcaaga
aaatccagctggggtgctgtccctgcacctgtcagagccccttaccacccacaatggggccctgactctaa
aaatgggggggcggcctgaccctggacaaggaagggaatctcacttcccaaaacatcaccagtgtcgatccc
cctctcaaaaaaagcaagaacaacatcagccttcagaccgccgcacccctcgccgtcagctccggggccct
aacccttttgccactccccccctagcggtcagtggcgacaaccttactgtgcagtctcaggcccctctta
ctttggaagactcaaaactaactctggccaccaaaggacccctaactgtgtccgaaggcaaacttgtccta
gaaacagagcctcccctgcatgcaagtgacagcagtagcctgggccttagcgtcacggccccacttagcat
taacaatgacagcctaggactagacatgcaagcgcccatcagctctcgagatggaaaactggctctaacag
tggcggccccccctaactgtggccgagggtatcaatgctttggcagtagccacaggtaatggtattggacta
aatgaaaccaacacacacctgcaggcaaaactggtcgcgcccctaggctttgataccaacggcaacattaa
gctaagcgtcgcaggaggcatgaggctaaacaataacacactgatactagatgtaaactacccatttgagg
ctcaaggccaactgagcctaagagtgggctcgggcccactatatgtagattctagtagtcataacctaacc
attagatgccttaggggattgtatgtaacatcttctaacaaccaaaacggtctagaggccaacattaaact
aacaaaaggccttgtgtatgacggaaatgccatagcagttaatgttggcaaagggctggaatacagcccta
ctggcacaacagaaaaacctatacagactaaaataggtctaggcatggagtatgacactgagggagccatg
atgacaaaactaggctctggactaagctttgacaattcaggagccattgtggtgggaaacaaaaatgatga
caggcttactttgtggaccacaccggacccatcgcccaactgtcagatttactctgaaaaagatgctaaac
taaccttggtactgactaaatgtggcagtcaggttgtaggcacagtatctattgccgctcttaaaggtagc
cttgtgccaatcactagtgcaatcagtgtggttcagatatacctaaggtttgatgaaaatggggtgctgat
gagtaactcttcacttaatggcgaatactggaattttagaaacggagactcaactaatggcacaccatata
caaacgcagtgggttttatgcctaatctactggcctatcctaaaggtcaaactacaactgcaaaaagtaac
attgtcagccaggtctacatgaacggggacgatactaaacccatgacatttacaatcaacttcaatggcct
tagtgaaacaggggataccccctgtcagtaaatattccatgacattctcatggaggtggccaaatggaagct
acatagggcacaattttgtaacaaactcctttactttctcctacatcgcccaagaataaagaaagcacaga
gatgcttgtttttgatttcaaaattgtgtgcttttatttattttcaagcttacagtatttccagtagtcat
tagaatagagcttaattaaactgcatgagaacccttccacatagcttaaatactagtggagaagtactcgc
ctacatgggggtagagtcataatcgtgcatcaggatagggcggtggtgctgcagcagcgcgcgaataaact
gctgccgccgccgctccgtcctgcaggaatacaacatggcagtggtctcctcagcgatgattcgcaccgcc
cgcagcataaggcgccttgtcctccgggcacagcagcgcaccctgatctcacttaaatcagcacagtaact
gcagcacagcaccacaatattgttcaaaatcccacagtgcaaggcgctgtatccaaagctcatggcgggga
ccacagaacccacgtggccatcataccacaagcgcaggtagattaagtggcgacccctcataaacacgctg
gacataaacattacctcttttggcatgttgtaattcaccacctcccggtaccatataaacctctgattaaa -continued catggcgccatccaccaccatcctaaaccagctggccaaaacctgcccgccggctatacactgcagggaac cgggactggaacaatgacagtggagagcccaggactcgtaaccatggatcatcatgctcgtcatgatatca atgttggcacaacacaggcacacgtgcatacacttcctcaggattacaagctcctcccgcgttagaaccat atcccagggaacaacccattcctgaatcagcgtaaatcccacactgcagggaagacctcgcacgtaactca cgttgtgcattgtcaaagtgttacattcgggcagcagcggatgatcctccagtatggtagcgcgggtttct gtctcaaaaggaggtagacgatccctactgtacggagtgcgccgagacaaccgagatcgtgttggtcgtag tgtcatgccaaatggaacgccggacgtagtcatatttcctgaagtcttcactctcacagcaccagcactaa tcagagtgtgaagagggccaagtgccgaacgagtatatataggaattaaaaatgacgtaaatgtgtaaagg tcaaaaaacgcccagaaaaatacacagaccaacgcccgaaacgaaaacccgcgaaaaaatacccagaagtt cctcaacaaccgccacttccgctttcccacgatacgtcacttcctcaaaaatagcaaactacatttcccac atgtacaaaaccaaaacccctccccttgtcaccgcccacaacttacataatcacaaacgtcaaagcctacg tcacccgccccgcctcgccccgcccacctcattatcatattggcctcaatccaaaataaggtatattattg atgatg Self-Replicating RNA Vector Production The TC-83 strain of Venezuelan Equine Encephalitis Virus (VEEV) genome sequence served as the base sequence used to construct the replicon of the invention. This sequence was modified by placing the Downstream LooP (DLP) from Sindbis virus upstream of the non-structural protein 1 (nsP1) with the two joined by a 2A ribosome skipping element from porcine teschovirus-1. The first 193 nucleotides of nsP1 were duplicated downstream of the 5' UTR and upstream of the DLP except for the start codon, which was mutated to TAG. This insured all regulatory and secondary structures necessary for replication were maintained but prevented translation of this partial nsp1 sequence. The structural genes were removed and EcoR V and Asc I restriction sites were placed downstream of the subgenomic promoter as a multiple cloning site (MCS) to facilitate insertion of any heterologous gene of interest (FIG. 10). The prostate neoantigens of the disclosure or synthetic genes comprising the optimized layouts of scrambled neoantigens designed for GAd20 and MVA expression were inserted in the cloning site. Each antigen was synthesized as a dsDNA fragment by IDT with 40 bp of homology to the MCS at their 5' and 3' ends. These were then cloned into the VEEV derived self-replicating RNA vector digested with EcoRV and AscI using NEB HiFi DNA assembly master mix (cat #E2621S). All constructs were sequenced verified.

The polynucleotide sequence of the full self-replicating RNA plasmid SEQ ID NO: 981

TAATACGACTCACTATAGATAGGCGGCGCATGAGAGAAGCCCAGACCAATTACCTACCCAAATAGGAGAAA

GTTCACGTTGACATCGAGGAAGACAGCCCATTCCTCAGAGCTTTGCAGCGGAGCTTCCCGCAGTTTGAGGT

AGAAGCCAAGCAGGTCACTGATAATGACCATGCTAATGCCAGAGCGTTTTCGCATCTGGCTTCAAAACTGA

TCGAAACGGAGGTGGACCCATCCGACACGATCCTTGACATTGGAATAGTCAGCATAGTACATTTCATCTGA

CTAATACTACAACACCACCACCATGAATAGAGGATTCTTTAACATGCTCGGCCGCCGCCCCTTCCCGGCCC

CCACTGCCATGTGGAGGCCGCGGAGAAGGAGGCAGGCGGCCCCGGGAAGCGGAGCTACTAACTTCAGCCTG

CTGAAGCAGGCTGGAGACGTGGAGGAGAACCCTGGACCTGAGAAAGTTCACGTTGACATCGAGGAAGACAG

CCCATTCCTCAGAGCTTTGCAGCGGAGCTTCCCGCAGTTTGAGGTAGAAGCCAAGCAGGTCACTGATAATG

ACCATGCTAATGCCAGAGCGTTTTCGCATCTGGCTTCAAAACTGATCGAAACGGAGGTGGACCCATCCGAC

ACGATCCTTGACATTGGAAGTGCGCCCGCCCGCAGAATGTATTCTAAGCACAAGTATCATTGTATCTGTCC

GATGAGATGTGCGGAAGATCCGGACAGATTGTATAAGTATGCAACTAAGCTGAAGAAAAACTGTAAGGAAA

TAACTGATAAGGAATTGGACAAGAAAATGAAGGAGCTCGCCGCCGTCATGAGCGACCCTGACCTGGAAACT

GAGACTATGTGCCTCCACGACGACGAGTCGTGTCGCTACGAAGGGCAAGTCGCTGTTTACCAGGATGTATA

CGCGGTTGACGGACCGACAAGTCTCTATCACCAAGCCAATAAGGGAGTTAGAGTCGCCTACTGGATAGGCT

TTGACACCACCCCTTTTATGTTTAAGAACTTGGCTGGAGCATATCCATCATACTCTACCAACTGGGCCGAC

GAAACCGTGTTAACGGCTCGTAACATAGGCCTATGCAGCTCTGACGTTATGGAGCGGTCACGTAGAGGGAT

GTCCATTCTTAGAAAGAAGTATTTGAAACCATCCAACAATGTTCTATTCTCTGTTGGCTCGACCATCTACC

-continued

ACGAGAAGAGGGACTTACTGAGGAGCTGGCACCTGCCGTCTGTATTTCACTTACGTGGCAAGCAAAATTAC

ACATGTCGGTGTGAGACTATAGTTAGTTGCGACGGGTACGTCGTTAAAAGAATAGCTATCAGTCCAGGCCT

GTATGGGAAGCCTTCAGGCTATGCTGCTACGATGCACCGCGAGGGATTCTTGTGCTGCAAAGTGACAGACA

CATTGAACGGGGAGAGGGTCTCTTTTCCCGTGTGCACGTATGTGCCAGCTACATTGTGTGACCAAATGACT

GGCATACTGGCAACAGATGTCAGTGCGGACGACGCGCAAAAACTGCTGGTTGGGCTCAACCAGCGTATAGT

CGTCAACGGTCGCACCCAGAGAAACACCAATACCATGAAAAATTACCTTTTGCCCGTAGTGGCCCAGGCAT

TTGCTAGGTGGGCAAAGGAATATAAGGAAGATCAAGAAGATGAAAGGCCACTAGGACTACGAGATAGACAG

TTAGTCATGGGGTGTTGTTGGGCTTTTAGAAGGCACAAGATAACATCTATTTATAAGCGCCCGGATACCCA

AACCATCATCAAAGTGAACAGCGATTTCCACTCATTCGTGCTGCCCAGGATAGGCAGTAACACATTGGAGA

TCGGGCTGAGAACAAGAATCAGGAAAATGTTAGAGGAGCACAAGGAGCCGTCACCTCTCATTACCGCCGAG

GACGTACAAGAAGCTAAGTGCGCAGCCGATGAGGCTAAGGAGGTGCGTGAAGCCGAGGAGTTGCGCGCAGC

TCTACCACCTTTGGCAGCTGATGTTGAGGAGCCCACTCTGGAAGCCGATGTCGACTTGATGTTACAAGAGG

CTGGGGCCGGCTCAGTGGAGACACCTCGTGGCTTGATAAAGGTTACCAGCTACGATGGCGAGGACAAGATC

GGCTCTTACGCTGTGCTTTCTCCGCAGGCTGTACTCAAGAGTGAAAAATTATCTTGCATCCACCCTCTCGC

TGAACAAGTCATAGTGATAACACACTCTGGCCGAAAAGGGCGTTATGCCGTGGAACCATACCATGGTAAAG

TAGTGGTGCCAGAGGGACATGCAATACCCGTCCAGGACTTTCAAGCTCTGAGTGAAAGTGCCACCATTGTG

TACAACGAACGTGAGTTCGTAAACAGGTACCTGCACCATATTGCCACACATGGAGGAGCGCTGAACACTGA

TGAAGAATATTACAAAACTGTCAAGCCCAGCGAGCACGACGGCGAATACCTGTACGACATCGACAGGAAAC

AGTGCGTCAAGAAAGAACTAGTCACTGGGCTAGGGCTCACAGGCGAGCTGGTGGATCCTCCCTTCCATGAA

TTCGCCTACGAGAGTCTGAGAACACGACCAGCCGCTCCTTACCAAGTACCAACCATAGGGGTGTATGGCGT

GCCAGGATCAGGCAAGTCTGGCATCATTAAAAGCGCAGTCACCAAAAAAGATCTAGTGGTGAGCGCCAAGA

AAGAAAACTGTGCAGAAATTATAAGGGACGTCAAGAAAATGAAAGGGCTGGACGTCAATGCCAGAACTGTG

GACTCAGTGCTCTTGAATGGATGCAAACACCCCGTAGAGACCCTGTATATTGACGAAGCTTTTGCTTGTCA

TGCAGGTACTCTCAGAGCGCTCATAGCCATTATAAGACCTAAAAAGGCAGTGCTCTGCGGGGATCCCAAAC

AGTGCGGTTTTTTTAACATGATGTGCCTGAAAGTGCATTTTAACCACGAGATTTGCACACAAGTCTTCCAC

AAAAGCATCTCTCGCCGTTGCACTAAATCTGTGACTTCGGTCGTCTCAACCTTGTTTTACGACAAAAAAAT

GAGAACGACGAATCCGAAAGAGACTAAGATTGTGATTGACACTACCGGCAGTACCAAACCTAAGCAGGACG

ATCTCATTCTCACTTGTTTCAGAGGGTGGGTGAAGCAGTTGCAAATAGATTACAAAGGCAACGAAATAATG

ACGGCAGCTGCCTCTCAAGGGCTGACCCGTAAAGGTGTGTATGCCGTTCGGTACAAGGTGAATGAAAATCC

TCTGTACGCACCCACCTCTGAACATGTGAACGTCCTACTGACCCGCACGGAGGACCGCATCGTGTGGAAAA

CACTAGCCGGCGACCCATGGATAAAAACACTGACTGCCAAGTACCCTGGGAATTTCACTGCCACGATAGAG

GAGTGGCAAGCAGAGCATGATGCCATCATGAGGCACATCTTGGAGAGACCGGACCCTACCGACGTCTTCCA

GAATAAGGCAAACGTGTGTTGGGCCAAGGCTTTAGTGCCGGTGCTGAAGACCGCTGGCATAGACATGACCA

CTGAACAATGGAACACTGTGGATTATTTTGAAACGGACAAAGCTCACTCAGCAGAGATAGTATTGAACCAA

CTATGCGTGAGGTTCTTTGGACTCGATCTGGACTCCGGTCTATTTTCTGCACCCACTGTTCCGTTATCCAT

TAGGAATAATCACTGGGATAACTCCCCGTCGCCTAACATGTACGGGCTGAATAAAGAAGTGGTCCGTCAGC

TCTCTCGCAGGTACCCACAACTGCCTCGGGCAGTTGCCACTGGAAGAGTCTATGACATGAACACTGGTACA

CTGCGCAATTATGATCCGCGCATAAACCTAGTACCTGTAAACAGAAGACTGCCTCATGCTTTAGTCCTCCA

CCATAATGAACACCCACAGAGTGACTTTTCTTCATTCGTCAGCAAATTGAAGGGCAGAACTGTCCTGGTGG

TCGGGGAAAAGTTGTCCGTCCCAGGCAAAATGGTTGACTGGTTGTCAGACCGGCCTGAGGCTACCTTCAGA

GCTCGGCTGGATTTAGGCATCCCAGGTGATGTGCCCAAATATGACATAATATTTGTTAATGTGAGGACCCC

-continued

ATATAAATACCATCACTATCAGCAGTGTGAAGACCATGCCATTAAGCTTAGCATGTTGACCAAGAAAGCTT

GTCTGCATCTGAATCCCGGCGGAACCTGTGTCAGCATAGGTTATGGTTACGCTGACAGGGCCAGCGAAAGC

ATCATTGGTGCTATAGCGCGGCAGTTCAAGTTTTCCCGGGTATGCAAACCGAAATCCTCACTTGAAGAGAC

GGAAGTTCTGTTTGTATTCATTGGGTACGATCGCAAGGCCCGTACGCACAATCCTTACAAGCTTTCATCAA

CCTTGACCAACATTTATACAGGTTCCAGACTCCACGAAGCCGGATGTGCACCCTCATATCATGTGGTGCGA

GGGGATATTGCCACGGCCACCGAAGGAGTGATTATAAATGCTGCTAACAGCAAAGGACAACCTGGCGGAGG

GGTGTGCGGAGCGCTGTATAAGAAATTCCCGGAAAGCTTCGATTTACAGCCGATCGAAGTAGGAAAAGCGC

GACTGGTCAAAGGTGCAGCTAAACATATCATTCATGCCGTAGGACCAAACTTCAACAAAGTTTCGGAGGTT

GAAGGTGACAAACAGTTGGCAGAGGCTTATGAGTCCATCGCTAAGATTGTCAACGATAACAATTACAAGTC

AGTAGCGATTCCACTGTTGTCCACCGGCATCTTTTCCGGGAACAAAGATCGACTAACCCAATCATTGAACC

ATTTGCTGACAGCTTTAGACACCACTGATGCAGATGTAGCCATATACTGCAGGGACAAGAAATGGGAAATG

ACTCTCAAGGAAGCAGTGGCTAGGAGAGAAGCAGTGGAGGAGATATGCATATCCGACGACTCTTCAGTGAC

AGAACCTGATGCAGAGCTGGTGAGGGTGCATCCGAAGAGTTCTTTGGCTGGAAGGAAGGGCTACAGCACAA

GCGATGGCAAAACTTTCTCATATTTGGAAGGGACCAAGTTTCACCAGGCGGCCAAGGATATAGCAGAAATT

AATGCCATGTGGCCCGTTGCAACGGAGGCCAATGAGCAGGTATGCATGTATATCCTCGGAGAAAGCATGAG

CAGTATTAGGTCGAAATGCCCCGTCGAAGAGTCGGAAGCCTCCACACCACCTAGCACGCTGCCTTGCTTGT

GCATCCATGCCATGACTCCAGAAAGAGTACAGCGCCTAAAAGCCTCACGTCCAGAACAAATTACTGTGTGC

TCATCCTTTCCATTGCCGAAGTATAGAATCACTGGTGTGCAGAAGATCCAATGCTCCCAGCCTATATTGTT

CTCACCGAAAGTGCCTGCGTATATTCATCCAAGGAAGTATCTCGTGGAAACACCACCGGTAGACGAGACTC

CGGAGCCATCGGCAGAGAACCAATCCACAGAGGGGACACCTGAACAACCACCACTTATAACCGAGGATGAG

ACCAGGACTAGAACGCCTGAGCCGATCATCATCGAAGAGGAAGAAGAGGATAGCATAAGTTTGCTGTCAGA

TGGCCCGACCCACCAGGTGCTGCAAGTCGAGGCAGACATTCACGGGCCGCCCTCTGTATCTAGCTCATCCT

GGTCCATTCCTCATGCATCCGACTTTGATGTGGACAGTTTATCCATACTTGACACCCTGGAGGGAGCTAGC

GTGACCAGCGGGGCAACGTCAGCCGAGACTAACTCTTACTTCGCAAAGAGTATGGAGTTTCTGGCGCGACC

GGTGCCTGCGCCTCGAACAGTATTCAGGAACCCTCCACATCCCGCTCCGCGCACAAGAACACCGTCACTTG

CACCCAGCAGGGCCTGCTCGAGAACCAGCCTAGTTTCCACCCCGCCAGGCGTGAATAGGGTGATCACTAGA

GAGGAGCTCGAGGCGCTTACCCCGTCACGCACTCCTAGCAGGTCGGTCTCGAGAACCAGCCTGGTCTCCAA

CCCGCCAGGCGTAAATAGGGTGATTACAAGAGAGGAGTTTGAGGCGTTCGTAGCACAACAACAATGACGGT

TTGATGCGGGTGCATACATCTTTTCCTCCGACACCGGTCAAGGGCATTTACAACAAAAATCAGTAAGGCAA

ACGGTGCTATCCGAAGTGGTGTTGGAGAGGACCGAATTGGAGATTTCGTATGCCCCGCGCCTCGACCAAGA

AAAAGAAGAATTACTACGCAAGAAATTACAGTTAAATCCCACACCTGCTAACAGAAGCAGATACCAGTCCA

GGAAGGTGGAGAACATGAAAGCCATAACAGCTAGACGTATTCTGCAAGGCCTAGGGCATTATTTGAAGGCA

GAAGGAAAAGTGGAGTGCTACCGAACCCTGCATCCTGTTCCTTTGTATTCATCTAGTGTGAACCGTGCCTT

TTCAAGCCCCAAGGTCGCAGTGGAAGCCTGTAACGCCATGTTGAAAGAGAACTTTCCGACTGTGGCTTCTT

ACTGTATTATTCCAGAGTACGATGCCTATTTGGACATGGTTGACGGAGCTTCATGCTGCTTAGACACTGCC

AGTTTTTGCCCTGCAAAGCTGCGCAGCTTTCCAAAGAAACACTCCTATTTGGAACCCACAATACGATCGGC

AGTGCCTTCAGCGATCCAGAACACGCTCCAGAACGTCCTGGCAGCTGCCACAAAAAGAAATTGCAATGTCA

CGCAAATGAGAGAATTGCCCGTATTGGATTCGGCGGCCTTTAATGTGGAATGCTTCAAGAAATATGCGTGT

AATAATGAATATTGGGAAACGTTTAAAGAAAACCCCATCAGGCTTACTGAAGAAAACGTGGTAAATTACAT

TACCAAATTAAAAGGACCAAAAGCTGCTGCTCTTTTTGCGAAGACACATAATTTGAATATGTTGCAGGACA

-continued

TACCAATGGACAGGTTTGTAATGGACTTAAAGAGAGACGTGAAAGTGACTCCAGGAACAAAACATACTGAA

GAACGGCCCAAGGTACAGGTGATCCAGGCTGCCGATCCGCTAGCAACAGCGTATCTGTGCGGAATCCACCG

AGAGCTGGTTAGGAGATTAAATGCGGTCCTGCTTCCGAACATTCATACACTGTTTGATATGTCGGCTGAAG

ACTTTGACGCTATTATAGCCGAGCACTTCCAGCCTGGGGATTGTGTTCTGGAAACTGACATCGCGTCGTTT

GATAAAAGTGAGGACGACGCCATGGCTCTGACCGCGTTAATGATTCTGGAAGACTTAGGTGTGGACGCAGA

GCTGTTGACGCTGATTGAGGCGGCTTTCGGCGAAATTTCATCAATACATTTGCCCACTAAAACTAAATTTA

AATTCGGAGCCATGATGAAATCTGGAATGTTCCTCACACTGTTTGTGAACACAGTCATTAACATTGTAATC

GCAAGCAGAGTGTTGAGAGAACGGCTAACCGGATCACCATGTGCAGCATTCATTGGAGATGACAATATCGT

GAAAGGAGTCAAATCGGACAAATTAATGGCAGACAGGTGCGCCACCTGGTTGAATATGGAAGTCAAGATTA

TAGATGCTGTGGTGGGCGAGAAAGCGCCTTATTTCTGTGGAGGGTTTATTTTGTGTGACTCCGTGACCGGC

ACAGCGTGCCGTGTGGCAGACCCCCTAAAAAGGCTGTTTAAGCTTGGCAAACCTCTGGCAGCAGACGATGA

ACATGATGATGACAGGAGAAGGGCATTGCATGAAGAGTCAACACGCTGGAACCGAGTGGGTATTCTTTCAG

AGCTGTGCAAGGCAGTAGAATCAAGGTATGAAACCGTAGGAACTTCCATCATAGTTATGGCCATGACTACT

CTAGCTAGCAGTGTTAAATCATTCAGCTACCTGAGAGGGGCCCCTATAACTCTCTACGGCTAACCTGAATG

GACTACGACATAGTCTAGTCCGCCAAGATATCGGCGCGCCGTTTAAACGGCCGGCCTTAATTAAGTAACGA

TACAGCAGCAATTGGCAAGCTGCTTACATAGAACTCGCGGCGATTGGCATGCCGCTTTAAAATTTTTATTT

TATTTTTCTTTTCTTTTCCGAATCGGATTTTGTTTTTAATATTTCAAAAAAAAAAAAAAAAAAAAAAAAAA

AAAAAAAAAAAAACCCCTCTCTAAACGGAGGGGTTTTTTTCAGCGTAACTGGACTGGCCACAGTTAGGCGG

CCGCGCATGTTCATCATCAGTAACCCGTATCGTGAGCATCCTCTCTCGTTTCATCGGTATCATTACCTCCA

TGAACAGAAATCCCCCTTACACGGAGGCATCAGTGACCAAACAGGAAAAAACCGCCCTTAACATGGCCCGC

TTTATCAGAAGCCAGACATTAACGCTTCTGGAGAAACTCAACGAGCTGGACGCGGATGAACAGGCAGACAT

CTGTGAATCGCTTCACGACCACGCTGATGAGCTTTACCGCAGCTGCCTCGCGCGTTTCGGTGATGACGGTG

AAAACCTCTGACACATGCAGCTCCCGGAGACGGTCACAGCTTGTCTGTAAGCGGATGCCGGGAGCAGACAA

GCCCGTCAGGGCGCGTCAGCGGGTGTTGGCGGGTGTCGGGGCGCAGCCATGACCCAGTCACGTAGCGATAG

CGGAGTGTATACTGGCTTAACTATGCGGCATCAGAGCAGATTGTACTGAGAGTGCACCATATGCGGTGTGA

AATACCGCACAGATGCGTAAGGAGAAAATACCGCATCAGGCGCTCGCTTCCTCGCTCACTGACTCGCTGCG

CTCGGTCGTTCGGCTGCGGCGAGCGGTATCAGCTCACTCAAAGGCGGTAATACGGTTATCCACAGAATCAG

GGGATAACGCAGGAAAGAACATGTGAGCAAAAGGCCAGCAAAAGGCCAGGAACCGTAAAAAGGCCGCGTTG

CTGGCGTTTTTCCATAGGCTCCGCCCCCCTGACGAGCATCACAAAAATCGACGCTCAAGTCAGAGGTGGCG

AAACCCGACAGGACTATAAAGATACCAGGCGTTTCCCCCTGGAAGCTCCCTCGTGCGCTCTCCTGTTCCGA

CCCTGCCGCTTACCGGATACCTGTCCGCCTTTCTCCCTTCGGGAAGCGTGGCGCTTTCTCATAGCTCACGC

TGTAGGTATCTCAGTTCGGTGTAGGTCGTTCGCTCCAAGCTGGGCTGTGTGCACGAACCCCCCGTTCAGCC

CGACCGCTGCGCCTTATCCGGTAACTATCGTCTTGAGTCCAACCCGGTAAGACACGACTTATCGCCACTGG

CAGCAGCCACTGGTAACAGGATTAGCAGAGCGAGGTATGTAGGCGGTGCTACAGAGTTCTTGAAGTGGTGG

CCTAACTACGGCTACACTAGAAGGACAGTATTTGGTATCTGCGCTCTGCTGAAGCCAGTTACCTTCGGAAA

AAGAGTTGGTAGCTCTTGATCCGGCAAACAAACCACCGCTGGTAGCGGTGGTTTTTTTGTTTGCAAGCAGC

AGATTACGCGCAGAAAAAAAGGATCTCAAGAAGATCCTTTGATCTTTTCTACGGGGTCTGACGCTCAGTGG

AACGAAAACTCACGTTAAGGGATTTTGGTCATGAGATTATCAAAAAGGATCTTCACCTAGATCCTTTTAAA

TTAAAAATGAAGTTTTAAATCAATCTAAAGTATATATGAGTAAACTTGGTCTGACAGTTATTAGAAAAATT

CATCCAGCAGACGATAAAACGCAATACGCTGGCTATCCGGTGCCGCAATGCCATACAGCACCAGAAAACGA

TCCGCCCATTCGCCGCCCAGTTCTTCCGCAATATCACGGGTGGCCAGCGCAATATCCTGATAACGATCCGC

-continued

CACGCCCAGACGGCCGCAATCAATAAAGCCGCTAAAACGGCCATTTTCCACCATAATGTTCGGCAGGCACG

CATCACCATGGGTCACCACCAGATCTTCGCCATCCGGCATGCTCGCTTTCAGACGCGCAAACAGCTCTGCC

GGTGCCAGGCCCTGATGTTCTTCATCCAGATCATCCTGATCCACCAGGCCCGCTTCCATACGGGTACGCGC

ACGTTCAATACGATGTTTCGCCTGATGATCAAACGGACAGGTCGCCGGGTCCAGGGTATGCAGACGACGCA

TGGCATCCGCCATAATGCTCACTTTTTCTGCCGGCGCCAGATGGCTAGACAGCAGATCCTGACCCGGCACT

TCGCCCAGCAGCAGCCAATCACGGCCCGCTTCGGTCACCACATCCAGCACCGCCGCACACGGAACACCGGT

GGTGGCCAGCCAGCTCAGACGCGCCGCTTCATCCTGCAGCTCGTTCAGCGCACCGCTCAGATCGGTTTTCA

CAAACAGCACCGGACGACCCTGCGCGCTCAGACGAAACACCGCCGCATCAGAGCAGCCAATGGTCTGCTGC

GCCCAATCATAGCCAAACAGACGTTCCACCCACGCTGCCGGGCTACCCGCATGCAGGCCATCCTGTTCAAT

CATACTCTTCCTTTTTCAATATTATTGAAGCATTTATCAGGGTTATTGTCTCATGAGCGGATACATATTTG

AATGTATTTAGAAAAATAAACAAATAGGGGTTCCGCGCACATTTCCCCGAAAAGTGCCACCTGACGTCTAA

GAAACCATTATTATCATGACATTAAGCATCCGCCTTTCGTTTTATTTGACCATGTTGGTATG

T7 terminator

SEQ ID NO: 982

AACCCCTCTCTAAACGGAGGGGTTTTTTT

AmpR promoter

SEQ ID NO: 983

CGCGGAACCCCTATTTGTTTATTTTTCTAAATACATTCAAATATGTATCCGCTCATGAGACAATAACCCTG

ATAAATGCTTCAATAATATTGAAAAAGGAAGAGT 26S promoter

SEQ ID NO: 984

CTCTCTACGGCTAACCTGAATGGA

T7 promoter

SEQ ID NO: 985

TAATACGACTCACTATAG

Poly A site

SEQ ID NO: 986

AAAAAAAAAAAAAAAAAAAAAAAAAAAAAAAAAAAAAAAA

Alpha 5' replication sequence from nsP1

SEQ ID NO: 987

TAGGAGAAAGTTCACGTTGACATCGAGGAAGACAGCCCATTCCTCAGAGCTTTGCAGCGGAGCTTCCCGCA

GTTTGAGGTAGAAGCCAAGCAGGTCACTGATAATGACCATGCTAATGCCAGAGCGTTTTCGCATCTGGCTT

CAAAACTGATCGAAACGGAGGTGGACCCATCCGACACGATCCTTGACATTGGA

DLP

SEQ ID NO: 988

ATAGTCAGCATAGTACATTTCATCTGACTAATACTACAACACCACCACCATGAATAGAGGATTCTTTAACA

TGCTCGGCCGCCGCCCCTTCCCGGCCCCCACTGCCATGTGGAGGCCGCGGAGAAGGAGGCAGGCGGCCCCG

P2A

SEQ ID NO: 989

GGAAGCGGAGCTACTAACTTCAGCCTGCTGAAGCAGGCTGGAGACGTGGAGGAGAACCCTGGACCT

Bon

SEQ ID NO; 990

CGCAGCCATGACCCAGTCACGTAGCGATAGCGGAGTGTATACTGGCTTAACTATGCGGCATCAGAGCAGAT

TGTACTGAGAGTGCACCATATGCGGTGTGAAATACCGCACAGATGCGTAAGGAGAAAATACCGCATCAGG

DLP nsp ORF

SEQ ID NO: 991

ATGAATAGAGGATTCTTTAACATGCTCGGCCGCCGCCCCTTCCCGGCCCCCACTGCCATGTGGAGGCCGCG

GAGAAGGAGGCAGGCGGCCCCGGGAAGCGGAGCTACTAACTTCAGCCTGCTGAAGCAGGCTGGAGACGTGG

AGGAGAACCCTGGACCTGAGAAAGTTCACGTTGACATCGAGGAAGACAGCCCATTCCTCAGAGCTTTGCAG

CGGAGCTTCCCGCAGTTTGAGGTAGAAGCCAAGCAGGTCACTGATAATGACCATGCTAATGCCAGAGCGTT

-continued

TTCGCATCTGGCTTCAAAACTGATCGAAACGGAGGTGGACCCATCCGACACGATCCTTGACATTGGAAGTG

CGCCCGCCCGCAGAATGTATTCTAAGCACAAGTATCATTGTATCTGTCCGATGAGATGTGCGGAAGATCCG

GACAGATTGTATAAGTATGCAACTAAGCTGAAGAAAAACTGTAAGGAAATAACTGATAAGGAATTGGACAA

GAAAATGAAGGAGCTCGCCGCCGTCATGAGCGACCCTGACCTGGAAACTGAGACTATGTGCCTCCACGACG

ACGAGTCGTGTCGCTACGAAGGGCAAGTCGCTGTTTACCAGGATGTATACGCGGTTGACGGACCGACAAGT

CTCTATCACCAAGCCAATAAGGGAGTTAGAGTCGCCTACTGGATAGGCTTTGACACCACCCCTTTTATGTT

TAAGAACTTGGCTGGAGCATATCCATCATACTCTACCAACTGGGCCGACGAAACCGTGTTAACGGCTCGTA

ACATAGGCCTATGCAGCTCTGACGTTATGGAGCGGTCACGTAGAGGGATGTCCATTCTTAGAAAGAAGTAT

TTGAAACCATCCAACAATGTTCTATTCTCTGTTGGCTCGACCATCTACCACGAGAAGAGGGACTTACTGAG

GAGCTGGCACCTGCCGTCTGTATTTCACTTACGTGGCAAGCAAAATTACACATGTCGGTGTGAGACTATAG

TTAGTTGCGACGGGTACGTCGTTAAAAGAATAGCTATCAGTCCAGGCCTGTATGGGAAGCCTTCAGGCTAT

GCTGCTACGATGCACCGCGAGGGATTCTTGTGCTGCAAAGTGACAGACACATTGAACGGGGAGAGGGTCTC

TTTTCCCGTGTGCACGTATGTGCCAGCTACATTGTGTGACCAAATGACTGGCATACTGGCAACAGATGTCA

GTGCGGACGACGCGCAAAAACTGCTGGTTGGGCTCAACCAGCGTATAGTCGTCAACGGTCGCACCCAGAGA

AACACCAATACCATGAAAAATTACCTTTTGCCCGTAGTGGCCCAGGCATTTGCTAGGTGGGCAAAGGAATA

TAAGGAAGATCAAGAAGATGAAAGGCCACTAGGACTACGAGATAGACAGTTAGTCATGGGGTGTTGTTGGG

CTTTTAGAAGGCACAAGATAACATCTATTTATAAGCGCCCGGATACCCAAACCATCATCAAAGTGAACAGC

GATTTCCACTCATTCGTGCTGCCCAGGATAGGCAGTAACACATTGGAGATCGGGCTGAGAACAAGAATCAG

GAAAATGTTAGAGGAGCACAAGGAGCCGTCACCTCTCATTACCGCCGAGGACGTACAAGAAGCTAAGTGCG

CAGCCGATGAGGCTAAGGAGGTGCGTGAAGCCGAGGAGTTGCGCGCAGCTCTACCACCTTTGGCAGCTGAT

GTTGAGGAGCCCACTCTGGAAGCCGATGTCGACTTGATGTTACAAGAGGCTGGGGCCGGCTCAGTGGAGAC

ACCTCGTGGCTTGATAAAGGTTACCAGCTACGATGGCGAGGACAAGATCGGCTCTTACGCTGTGCTTTCTC

CGCAGGCTGTACTCAAGAGTGAAAAATTATCTTGCATCCACCCTCTCGCTGAACAAGTCATAGTGATAACA

CACTCTGGCCGAAAAGGGCGTTATGCCGTGGAACCATACCATGGTAAAGTAGTGGTGCCAGAGGGACATGC

AATACCCGTCCAGGACTTTCAAGCTCTGAGTGAAAGTGCCACCATTGTGTACAACGAACGTGAGTTCGTAA

ACAGGTACCTGCACCATATTGCCACACATGGAGGAGCGCTGAACACTGATGAAGAATATTACAAAACTGTC

AAGCCCAGCGAGCACGACGGCGAATACCTGTACGACATCGACAGGAAACAGTGCGTCAAGAAAGAACTAGT

CACTGGGCTAGGGCTCACAGGCGAGCTGGTGGATCCTCCCTTCCATGAATTCGCCTACGAGAGTCTGAGAA

CACGACCAGCCGCTCCTTACCAAGTACCAACCATAGGGGTGTATGGCGTGCCAGGATCAGGCAAGTCTGGC

ATCATTAAAAGCGCAGTCACCAAAAAAGATCTAGTGGTGAGCGCCAAGAAAGAAAACTGTGCAGAAATTAT

AAGGGACGTCAAGAAAATGAAAGGGCTGGACGTCAATGCCAGAACTGTGGACTCAGTGCTCTTGAATGGAT

GCAAACACCCCGTAGAGACCCTGTATATTGACGAAGCTTTTGCTTGTCATGCAGGTACTCTCAGAGCGCTC

ATAGCCATTATAAGACCTAAAAAGGCAGTGCTCTGCGGGGATCCCAAACAGTGCGGTTTTTTTAACATGAT

GTGCCTGAAAGTGCATTTTAACCACGAGATTTGCACACAAGTCTTCCACAAAAGCATCTCTCGCCGTTGCA

CTAAATCTGTGACTTCGGTCGTCTCAACCTTGTTTTACGACAAAAAAATGAGAACGACGAATCCGAAAGAG

ACTAAGATTGTGATTGACACTACCGGCAGTACCAAACCTAAGCAGGACGATCTCATTCTCACTTGTTTCAG

AGGGTGGGTGAAGCAGTTGCAAATAGATTACAAAGGCAACGAAATAATGACGGCAGCTGCCTCTCAAGGGC

TGACCCGTAAAGGTGTGTATGCCGTTCGGTACAAGGTGAATGAAAATCCTCTGTACGCACCCACCTCTGAA

CATGTGAACGTCCTACTGACCCGCACGGAGGACCGCATCGTGTGGAAAACACTAGCCGGCGACCCATGGAT

AAAAACACTGACTGCCAAGTACCCTGGGAATTTCACTGCCACGATAGAGGAGTGGCAAGCAGAGCATGATG

CCATCATGAGGCACATCTTGGAGAGACCGGACCCTACCGACGTCTTCCAGAATAAGGCAAACGTGTGTTGG

-continued

GCCAAGGCTTTAGTGCCGGTGCTGAAGACCGCTGGCATAGACATGACCACTGAACAATGGAACACTGTGGA

TTATTTTGAAACGGACAAAGCTCACTCAGCAGAGATAGTATTGAACCAACTATGCGTGAGGTTCTTTGGAC

TCGATCTGGACTCCGGTCTATTTTCTGCACCCACTGTTCCGTTATCCATTAGGAATAATCACTGGGATAAC

TCCCCGTCGCCTAACATGTACGGGCTGAATAAAGAAGTGGTCCGTCAGCTCTCTCGCAGGTACCCACAACT

GCCTCGGGCAGTTGCCACTGGAAGAGTCTATGACATGAACACTGGTACACTGCGCAATTATGATCCGCGCA

TAAACCTAGTACCTGTAAACAGAAGACTGCCTCATGCTTTAGTCCTCCACCATAATGAACACCCACAGAGT

GACTTTTCTTCATTCGTCAGCAAATTGAAGGGCAGAACTGTCCTGGTGGTCGGGGAAAAGTTGTCCGTCCC

AGGCAAAATGGTTGACTGGTTGTCAGACCGGCCTGAGGCTACCTTCAGAGCTCGGCTGGATTTAGGCATCC

CAGGTGATGTGCCCAAATATGACATAATATTTGTTAATGTGAGGACCCCATATAAATACCATCACTATCAG

CAGTGTGAAGACCATGCCATTAAGCTTAGCATGTTGACCAAGAAAGCTTGTCTGCATCTGAATCCCGGCGG

AACCTGTGTCAGCATAGGTTATGGTTACGCTGACAGGGCCAGCGAAAGCATCATTGGTGCTATAGCGCGGC

AGTTCAAGTTTTCCCGGGTATGCAAACCGAAATCCTCACTTGAAGAGACGGAAGTTCTGTTTGTATTCATT

GGGTACGATCGCAAGGCCCGTACGCACAATCCTTACAAGCTTTCATCAACCTTGACCAACATTTATACAGG

TTCCAGACTCCACGAAGCCGGATGTGCACCCTCATATCATGTGGTGCGAGGGGATATTGCCACGGCCACCG

AAGGAGTGATTATAAATGCTGCTAACAGCAAAGGACAACCTGGCGGAGGGGTGTGCGGAGCGCTGTATAAG

AAATTCCCGGAAAGCTTCGATTTACAGCCGATCGAAGTAGGAAAAGCGCGACTGGTCAAAGGTGCAGCTAA

ACATATCATTCATGCCGTAGGACCAAACTTCAACAAAGTTTCGGAGGTTGAAGGTGACAAACAGTTGGCAG

AGGCTTATGAGTCCATCGCTAAGATTGTCAACGATAACAATTACAAGTCAGTAGCGATTCCACTGTTGTCC

ACCGGCATCTTTTCCGGGAACAAAGATCGACTAACCCAATCATTGAACCATTTGCTGACAGCTTTAGACAC

CACTGATGCAGATGTAGCCATATACTGCAGGGACAAGAAATGGGAAATGACTCTCAAGGAAGCAGTGGCTA

GGAGAGAAGCAGTGGAGGAGATATGCATATCCGACGACTCTTCAGTGACAGAACCTGATGCAGAGCTGGTG

AGGGTGCATCCGAAGAGTTCTTTGGCTGGAAGGAAGGGCTACAGCACAAGCGATGGCAAAACTTTCTCATA

TTTGGAAGGGACCAAGTTTCACCAGGCGGCCAAGGATATAGCAGAAATTAATGCCATGTGGCCCGTTGCAA

CGGAGGCCAATGAGCAGGTATGCATGTATATCCTCGGAGAAAGCATGAGCAGTATTAGGTCGAAATGCCCC

GTCGAAGAGTCGGAAGCCTCCACACCACCTAGCACGCTGCCTTGCTTGTGCATCCATGCCATGACTCCAGA

AAGAGTACAGCGCCTAAAAGCCTCACGTCCAGAACAAATTACTGTGTGCTCATCCTTTCCATTGCCGAAGT

ATAGAATCACTGGTGTGCAGAAGATCCAATGCTCCCAGCCTATATTGTTCTCACCGAAAGTGCCTGCGTAT

ATTCATCCAAGGAAGTATCTCGTGGAAACACCACCGGTAGACGAGACTCCGGAGCCATCGGCAGAGAACCA

ATCCACAGAGGGGACACCTGAACAACCACCACTTATAACCGAGGATGAGACCAGGACTAGAACGCCTGAGC

CGATCATCATCGAAGAGGAAGAAGAGGATAGCATAAGTTTGCTGTCAGATGGCCCGACCCACCAGGTGCTG

CAAGTCGAGGCAGACATTCACGGGCCGCCCTCTGTATCTAGCTCATCCTGGTCCATTCCTCATGCATCCGA

CTTTGATGTGGACAGTTTATCCATACTTGACACCCTGGAGGGAGCTAGCGTGACCAGCGGGGCAACGTCAG

CCGAGACTAACTCTTACTTCGCAAAGAGTATGGAGTTTCTGGCGCGACCGGTGCCTGCGCCTCGAACAGTA

TTCAGGAACCCTCCACATCCCGCTCCGCGCACAAGAACACCGTCACTTGCACCCAGCAGGGCCTGCTCGAG

AACCAGCCTAGTTTCCACCCCGCCAGGCGTGAATAGGGTGATCACTAGAGAGGAGCTCGAGGCGCTTACCC

CGTCACGCACTCCTAGCAGGTCGGTCTCGAGAACCAGCCTGGTCTCCAACCCGCCAGGCGTAAATAGGGTG

ATTACAAGAGAGGAGTTTGAGGCGTTCGTAGCACAACAACAATGA

NsP2

SEQ ID NO: 992

GGCTCAGTGGAGACACCTCGTGGCTTGATAAAGGTTACCAGCTACGATGGCGAGGACAAGATCGGCTCTTA

CGCTGTGCTTTCTCCGCAGGCTGTACTCAAGAGTGAAAAATTATCTTGCATCCACCCTCTCGCTGAACAAG

-continued

TCATAGTGATAACACACTCTGGCCGAAAAGGGCGTTATGCCGTGGAACCATACCATGGTAAAGTAGTGGTG

CCAGAGGGACATGCAATACCCGTCCAGGACTTTCAAGCTCTGAGTGAAAGTGCCACCATTGTGTACAACGA

ACGTGAGTTCGTAAACAGGTACCTGCACCATATTGCCACACATGGAGGAGCGCTGAACACTGATGAAGAAT

ATTACAAAACTGTCAAGCCCAGCGAGCACGACGGCGAATACCTGTACGACATCGACAGGAAACAGTGCGTC

AAGAAAGAACTAGTCACTGGGCTAGGGCTCACAGGCGAGCTGGTGGATCCTCCCTTCCATGAATTCGCCTA

CGAGAGTCTGAGAACACGACCAGCCGCTCCTTACCAAGTACCAACCATAGGGGTGTATGGCGTGCCAGGAT

CAGGCAAGTCTGGCATCATTAAAAGCGCAGTCACCAAAAAAGATCTAGTGGTGAGCGCCAAGAAAGAAAAC

TGTGCAGAAATTATAAGGGACGTCAAGAAAATGAAAGGGCTGGACGTCAATGCCAGAACTGTGGACTCAGT

GCTCTTGAATGGATGCAAACACCCCGTAGAGACCCTGTATATTGACGAAGCTTTTGCTTGTCATGCAGGTA

CTCTCAGAGCGCTCATAGCCATTATAAGACCTAAAAAGGCAGTGCTCTGCGGGGATCCCAAACAGTGCGGT

TTTTTAACATGATGTGCCTGAAAGTGCATTTTAACCACGAGATTTGCACACAAGTCTTCCACAAAAGCAT

CTCTCGCCGTTGCACTAAATCTGTGACTTCGGTCGTCTCAACCTTGTTTTACGACAAAAAAATGAGAACGA

CGAATCCGAAAGAGACTAAGATTGTGATTGACACTACCGGCAGTACCAAACCTAAGCAGGACGATCTCATT

CTCACTTGTTTCAGAGGGTGGGTGAAGCAGTTGCAAATAGATTACAAAGGCAACGAAATAATGACGGCAGC

TGCCTCTCAAGGGCTGACCCGTAAAGGTGTGTATGCCGTTCGGTACAAGGTGAATGAAAATCCTCTGTACG

CACCCACCTCTGAACATGTGAACGTCCTACTGACCCGCACGGAGGACCGCATCGTGTGGAAAACACTAGCC

GGCGACCCATGGATAAAAACACTGACTGCCAAGTACCCTGGGAATTTCACTGCCACGATAGAGGAGTGGCA

AGCAGAGCATGATGCCATCATGAGGCACATCTTGGAGAGACCGGACCCTACCGACGTCTTCCAGAATAAGG

CAAACGTGTGTTGGGCCAAGGCTTTAGTGCCGGTGCTGAAGACCGCTGGCATAGACATGACCACTGAACAA

TGGAACACTGTGGATTATTTTGAAACGGACAAAGCTCACTCAGCAGAGATAGTATTGAACCAACTATGCGT

GAGGTTCTTTGGACTCGATCTGGACTCCGGTCTATTTTCTGCACCCACTGTTCCGTTATCCATTAGGAATA

ATCACTGGGATAACTCCCCGTCGCCTAACATGTACGGGCTGAATAAAGAAGTGGTCCGTCAGCTCTCTCGC

AGGTACCCACAACTGCCTCGGGCAGTTGCCACTGGAAGAGTCTATGACATGAACACTGGTACACTGCGCAA

TTATGATCCGCGCATAAACCTAGTACCTGTAAACAGAAGACTGCCTCATGCTTTAGTCCTCCACCATAATG

AACACCCACAGAGTGACTTTTCTTCATTCGTCAGCAAATTGAAGGGCAGAACTGTCCTGGTGGTCGGGGAA

AAGTTGTCCGTCCCAGGCAAAATGGTTGACTGGTTGTCAGACCGGCCTGAGGCTACCTTCAGAGCTCGGCT

GGATTTAGGCATCCCAGGTGATGTGCCCAAATATGACATAATATTTGTTAATGTGAGGACCCCATATAAAT

ACCATCACTATCAGCAGTGTGAAGACCATGCCATTAAGCTTAGCATGTTGACCAAGAAAGCTTGTCTGCAT

CTGAATCCCGGCGGAACCTGTGTCAGCATAGGTTATGGTTACGCTGACAGGGCCAGCGAAAGCATCATTGG

TGCTATAGCGCGGCAGTTCAAGTTTTCCCGGGTATGCAAACCGAAATCCTCACTTGAAGAGACGGAAGTTC

TGTTTGTATTCATTGGGTACGATCGCAAGGCCCGTACGCACAATCCTTACAAGCTTTCATCAACCTTGACC

AACATTTATACAGGTTCCAGACTCCACGAAGCCGGATGT nsP4

SEQ ID NO: 993

TACATCTTTTCCTCCGACACCGGTCAAGGGCATTTACAACAAAAATCAGTAAGGCAAACGGTGCTATCCGA

AGTGGTGTTGGAGAGGACCGAATTGGAGATTTCGTATGCCCCGCGCCTCGACCAAGAAAAAGAAGAATTAC

TACGCAAGAAATTACAGTTAAATCCCACACCTGCTAACAGAAGCAGATACCAGTCCAGGAAGGTGGAGAAC

ATGAAAGCCATAACAGCTAGACGTATTCTGCAAGGCCTAGGGCATTATTTGAAGGCAGAAGGAAAAGTGGA

GTGCTACCGAACCCTGCATCCTGTTCCTTTGTATTCATCTAGTGTGAACCGTGCCTTTTCAAGCCCCAAGG

TCGCAGTGGAAGCCTGTAACGCCATGTTGAAAGAGAACTTTCCGACTGTGGCTTCTTACTGTATTATTCCA

GAGTACGATGCCTATTTGGACATGGTTGACGGAGCTTCATGCTGCTTAGACACTGCCAGTTTTTGCCCTGC

AAAGCTGCGCAGCTTTCCAAAGAAACACTCCTATTTGGAACCCACAATACGATCGGCAGTGCCTTCAGCGA

-continued

TCCAGAACACGCTCCAGAACGTCCTGGCAGCTGCCACAAAAAGAAATTGCAATGTCACGCAAATGAGAGAA

TTGCCCGTATTGGATTCGGCGGCCTTTAATGTGGAATGCTTCAAGAAATATGCGTGTAATAATGAATATTG

GGAAACGTTTAAAGAAAACCCCATCAGGCTTACTGAAGAAAACGTGGTAAATTACATTACCAAATTAAAAG

GACCAAAAGCTGCTGCTCTTTTTGCGAAGACACATAATTTGAATATGTTGCAGGACATACCAATGGACAGG

TTTGTAATGGACTTAAAGAGAGACGTGAAAGTGACTCCAGGAACAAAACATACTGAAGAACGGCCCAAGGT

ACAGGTGATCCAGGCTGCCGATCCGCTAGCAACAGCGTATCTGTGCGGAATCCACCGAGAGCTGGTTAGGA

GATTAAATGCGGTCCTGCTTCCGAACATTCATACACTGTTTGATATGTCGGCTGAAGACTTTGACGCTATT

ATAGCCGAGCACTTCCAGCCTGGGGATTGTGTTCTGGAAACTGACATCGCGTCGTTTGATAAAAGTGAGGA

CGACGCCATGGCTCTGACCGCGTTAATGATTCTGGAAGACTTAGGTGTGGACGCAGAGCTGTTGACGCTGA

TTGAGGCGGCTTTCGGCGAAATTTCATCAATACATTTGCCCACTAAAACTAAATTTAAATTCGGAGCCATG

ATGAAATCTGGAATGTTCCTCACACTGTTTGTGAACACAGTCATTAACATTGTAATCGCAAGCAGAGTGTT

GAGAGAACGGCTAACCGGATCACCATGTGCAGCATTCATTGGAGATGACAATATCGTGAAAGGAGTCAAAT

CGGACAAATTAATGGCAGACAGGTGCGCCACCTGGTTGAATATGGAAGTCAAGATTATAGATGCTGTGGTG

GGCGAGAAAGCGCCTTATTTCTGTGGAGGGTTTATTTTGTGTGACTCCGTGACCGGCACAGCGTGCCGTGT

GGCAGACCCCCTAAAAAGGCTGTTTAAGCTTGGCAAACCTCTGGCAGCAGACGATGAACATGATGATGACA

GGAGAAGGGCATTGCATGAAGAGTCAACACGCTGGAACCGAGTGGGTATTCTTTCAGAGCTGTGCAAGGCA

GTAGAATCAAGGTATGAAACCGTAGGAACTTCCATCATAGTTATGGCCATGACTACTCTAGCTAGCAGTGT

TAAATCATTCAGCTACCTGAGAGGGGCCCCTATAACTCTCTACGGC nsP3

SEQ ID NO: 994

GCACCCTCATATCATGTGGTGCGAGGGGATATTGCCACGGCCACCGAAGGAGTGATTATAAATGCTGCTAA

CAGCAAAGGACAACCTGGCGGAGGGGTGTGCGGAGCGCTGTATAAGAAATTCCCGGAAAGCTTCGATTTAC

AGCCGATCGAAGTAGGAAAAGCGCGACTGGTCAAAGGTGCAGCTAAACATATCATTCATGCCGTAGGACCA

AACTTCAACAAAGTTTCGGAGGTTGAAGGTGACAAACAGTTGGCAGAGGCTTATGAGTCCATCGCTAAGAT

TGTCAACGATAACAATTACAAGTCAGTAGCGATTCCACTGTTGTCCACCGGCATCTTTTCCGGGAACAAAG

ATCGACTAACCCAATCATTGAACCATTTGCTGACAGCTTTAGACACCACTGATGCAGATGTAGCCATATAC

TGCAGGGACAAGAAATGGGAAATGACTCTCAAGGAAGCAGTGGCTAGGAGAGAAGCAGTGGAGGAGATATG

CATATCCGACGACTCTTCAGTGACAGAACCTGATGCAGAGCTGGTGAGGGTGCATCCGAAGAGTTCTTTGG

CTGGAAGGAAGGGCTACAGCACAAGCGATGGCAAAACTTTCTCATATTTGGAAGGGACCAAGTTTCACCAG

GCGGCCAAGGATATAGCAGAAATTAATGCCATGTGGCCCGTTGCAACGGAGGCCAATGAGCAGGTATGCAT

GTATATCCTCGGAGAAAGCATGAGCAGTATTAGGTCGAAATGCCCCGTCGAAGAGTCGGAAGCCTCCACAC

CACCTAGCACGCTGCCTTGCTTGTGCATCCATGCCATGACTCCAGAAAGAGTACAGCGCCTAAAAGCCTCA

CGTCCAGAACAAATTACTGTGTGCTCATCCTTTCCATTGCCGAAGTATAGAATCACTGGTGTGCAGAAGAT

CCAATGCTCCCAGCCTATATTGTTCTCACCGAAAGTGCCTGCGTATATTCATCCAAGGAAGTATCTCGTGG

AAACACCACCGGTAGACGAGACTCCGGAGCCATCGGCAGAGAACCAATCCACAGAGGGGACACCTGAACAA

CCACCACTTATAACCGAGGATGAGACCAGGACTAGAACGCCTGAGCCGATCATCATCGAAGAGGAAGAAGA

GGATAGCATAAGTTTGCTGTCAGATGGCCCGACCCACCAGGTGCTGCAAGTCGAGGCAGACATTCACGGGC

CGCCCTCTGTATCTAGCTCATCCTGGTCCATTCCTCATGCATCCGACTTTGATGTGGACAGTTTATCCATA

CTTGACACCCTGGAGGGAGCTAGCGTGACCAGCGGGGCAACGTCAGCCGAGACTAACTCTTACTTCGCAAA

GAGTATGGAGTTTCTGGCGCGACCGGTGCCTGCGCCTCGAACAGTATTCAGGAACCCTCCACATCCCGCTC

CGCGCACAAGAACACCGTCACTTGCACCCAGCAGGGCCTGCTCGAGAACCAGCCTAGTTTCCACCCCGCCA

-continued

GGCGTGAATAGGGTGATCACTAGAGAGGAGCTCGAGGCGCTTACCCCGTCACGCACTCCTAGCAGGTCGGT

CTCGAGAACCAGCCTGGTCTCCAACCCGCCAGGCGTAAATAGGGTGATTACAAGAGAGGAGTTTGAGGCGT

TCGTAGCACAACAACAATGACGGTTTGATGCGGGTGCA nsP1

SEQ ID NO: 995

GAGAAAGTTCACGTTGACATCGAGGAAGACAGCCCATTCCTCAGAGCTTTGCAGCGGAGCTTCCCGCAGTT

TGAGGTAGAAGCCAAGCAGGTCACTGATAATGACCATGCTAATGCCAGAGCGTTTTCGCATCTGGCTTCAA

AACTGATCGAAACGGAGGTGGACCCATCCGACACGATCCTTGACATTGGAAGTGCGCCCGCCCGCAGAATG

TATTCTAAGCACAAGTATCATTGTATCTGTCCGATGAGATGTGCGGAAGATCCGGACAGATTGTATAAGTA

TGCAACTAAGCTGAAGAAAAACTGTAAGGAAATAACTGATAAGGAATTGGACAAGAAAATGAAGGAGCTCG

CCGCCGTCATGAGCGACCCTGACCTGGAAACTGAGACTATGTGCCTCCACGACGACGAGTCGTGTCGCTAC

GAAGGGCAAGTCGCTGTTTACCAGGATGTATACGCGGTTGACGGACCGACAAGTCTCTATCACCAAGCCAA

TAAGGGAGTTAGAGTCGCCTACTGGATAGGCTTTGACACCACCCCTTTTATGTTTAAGAACTTGGCTGGAG

CATATCCATCATACTCTACCAACTGGGCCGACGAAACCGTGTTAACGGCTCGTAACATAGGCCTATGCAGC

TCTGACGTTATGGAGCGGTCACGTAGAGGGATGTCCATTCTTAGAAAGAAGTATTTGAAACCATCCAACAA

TGTTCTATTCTCTGTTGGCTCGACCATCTACCACGAGAAGAGGGACTTACTGAGGAGCTGGCACCTGCCGT

CTGTATTTCACTTACGTGGCAAGCAAAATTACACATGTCGGTGTGAGACTATAGTTAGTTGCGACGGGTAC

GTCGTTAAAAGAATAGCTATCAGTCCAGGCCTGTATGGGAAGCCTTCAGGCTATGCTGCTACGATGCACCG

CGAGGGATTCTTGTGCTGCAAAGTGACAGACACATTGAACGGGGAGAGGGTCTCTTTTCCCGTGTGCACGT

ATGTGCCAGCTACATTGTGTGACCAAATGACTGGCATACTGGCAACAGATGTCAGTGCGGACGACGCGCAA

AAACTGCTGGTTGGGCTCAACCAGCGTATAGTCGTCAACGGTCGCACCCAGAGAAACACCAATACCATGAA

AAATTACCTTTTGCCCGTAGTGGCCCAGGCATTTGCTAGGTGGGCAAAGGAATATAAGGAAGATCAAGAAG

ATGAAAGGCCACTAGGACTACGAGATAGACAGTTAGTCATGGGGTGTTGTTGGGCTTTTAGAAGGCACAAG

ATAACATCTATTTATAAGCGCCCGGATACCCAAACCATCATCAAAGTGAACAGCGATTTCCACTCATTCGT

GCTGCCCAGGATAGGCAGTAACACATTGGAGATCGGGCTGAGAACAAGAATCAGGAAAATGTTAGAGGAGC

ACAAGGAGCCGTCACCTCTCATTACCGCCGAGGACGTACAAGAAGCTAAGTGCGCAGCCGATGAGGCTAAG

GAGGTGCGTGAAGCCGAGGAGTTGCGCGCAGCTCTACCACCTTTGGCAGCTGATGTTGAGGAGCCCACTCT

GGAAGCCGATGTCGACTTGATGTTACAAGAGGCTGGGGCC

KanR

SEQ ID NO: 996

ATGATTGAACAGGATGGCCTGCATGCGGGTAGCCCGGCAGCGTGGGTGGAACGTCTGTTTGGCTATGATTG

GGCGCAGCAGACCATTGGCTGCTCTGATGCGGCGGTGTTTCGTCTGAGCGCGCAGGGTCGTCCGGTGCTGT

TTGTGAAAACCGATCTGAGCGGTGCGCTGAACGAGCTGCAGGATGAAGCGGCGCGTCTGAGCTGGCTGGCC

ACCACCGGTGTTCCGTGTGCGGCGGTGCTGGATGTGGTGACCGAAGCGGGCCGTGATTGGCTGCTGCTGGG

CGAAGTGCCGGGTCAGGATCTGCTGTCTAGCCATCTGGCGCCGGCAGAAAAAGTGAGCATTATGGCGGATG

CCATGCGTCGTCTGCATACCCTGGACCCGGCGACCTGTCCGTTTGATCATCAGGCGAAACATCGTATTGAA

CGTGCGCGTACCCGTATGGAAGCGGGCCTGGTGGATCAGGATGATCTGGATGAAGAACATCAGGGCCTGGC

ACCGGCAGAGCTGTTTGCGCGTCTGAAAGCGAGCATGCCGGATGGCGAAGATCTGGTGGTGACCCATGGTG

ATGCGTGCCTGCCGAACATTATGGTGGAAAATGGCCGTTTTAGCGGCTTTATTGATTGCGGCCGTCTGGGC

GTGGCGGATCGTTATCAGGATATTGCGCTGGCCACCCGTGATATTGCGGAAGAACTGGGCGGCGAATGGGC

GGATCGTTTTCTGGTGCTGTATGGCATTGCGGCACCGGATAGCCAGCGTATTGCGTTTTATCGTCTGCTGG

ATGAATTTTTCTAATAA

-continued

Rop

SEQ ID NO: 997

GTGACCAAACAGGAAAAAACCGCCCTTAACATGGCCCGCTTTATCAGAAGCCAGACATTAACGCTTCTGGA

GAAACTCAACGAGCTGGACGCGGATGAACAGGCAGACATCTGTGAATCGCTTCACGACCACGCTGATGAGC

TTTACCGCAGCTGCCTCGCGCGTTTCGGTGATGACGGTGAAAACCTCTGA

5'-UTR

SEQ ID NO: 998

ATAGGCGGCGCATGAGAGAAGCCCAGACCAATTACCTACCCAAA

3'-UTR

SEQ ID NO: 999

ATACAGCAGCAATTGGCAAGCTGCTTACATAGAACTCGCGGCGATTGGCATGCCGCTTTAAAATTTTTATT

TTATTTTTCTTTTCTTTTCCGAATCGGATTTTGTTTTTAATATTTC

Figure 7:
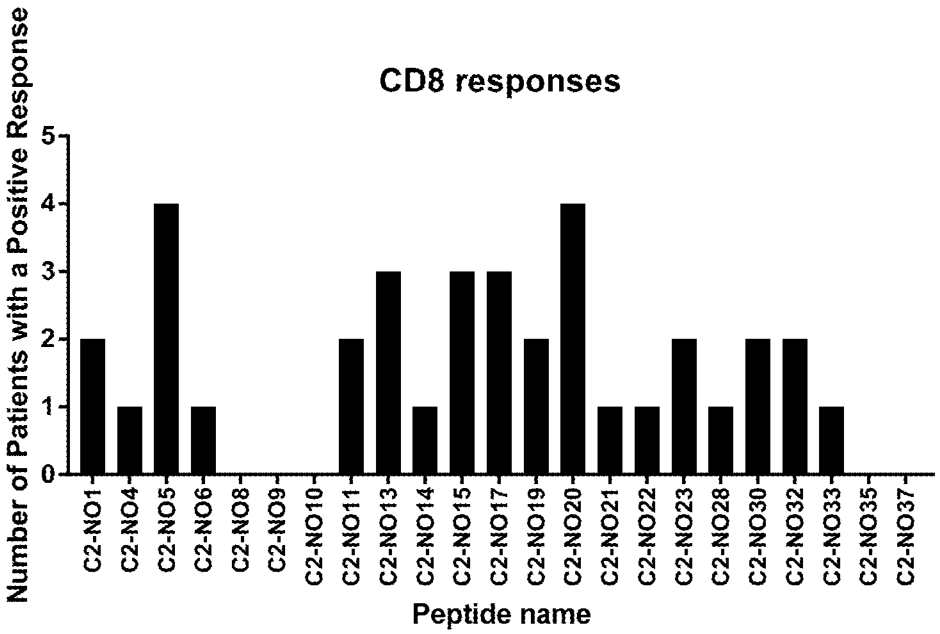
FIG. 7 shows the number of prostate cancer patients whose PBMC samples demonstrated a positive $CD4^{+}$ immune response to the specified neoantigens.
Figure 8:
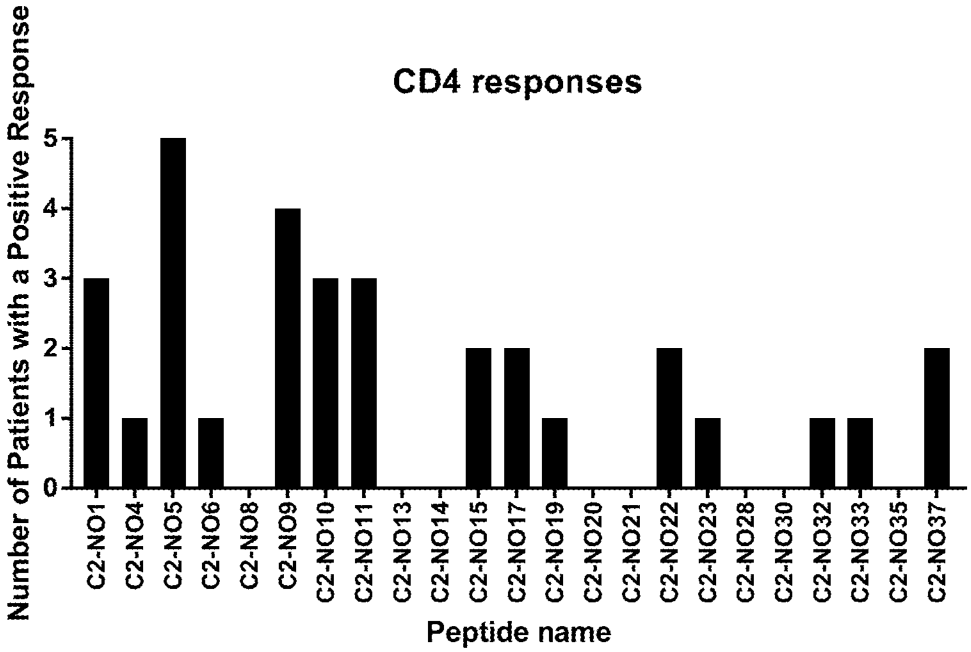
FIG. 8 shows the number of prostate cancer patients whose PBMC samples demonstrated a positive $CD8^{+}$ immune response to the specified neoantigens.

Example 10. Neoantigens Incorporated into NeoGAd20 and NeoMVA are Immunogenic In Vitro Overlapping 15-mer peptides were designed to span each neoantigen incorporated into NeoGAd20 and NeoMVA to assess their ability to activate T cells using the exogenous autologous normal donor restimulation assay described in Example 1 as pools using TNFα and IFNγ production by $CD8^+$ and $CD4^+$ T cells as a readout. Table 25 shows the maximum frequency of $TNF\alpha^+IFN\gamma^+CD8^+$ and $TNF\alpha^+IFN\gamma^+CD4^+$ T cells and maximum fold change over negative control for the pool of peptides analyzed, indicating the highest frequency of $TNF\alpha^+IFN\gamma^+CD8^+$ and $TNF\alpha^+IFN\gamma^+CD4^+$ T cells and resulting fold change across the normal donors evaluated for the peptide. Table 26 shows the peptide sequences used. FIG. 7 shows the number of patients with a positive CD8+ response for each tested peptide pool for select neoantigens. FIG. 8 shows the number of patients with a positive CD4+ response for each tested peptide pool for select neoantigens.

TABLE 25

| Neoantigen ID (Alternative name) | Maximum Fold Change Over Background CD8+ cells | Maximum Frequency of TNFα/IFNγ Double Positive CD8+ T cells | Maximum Fold Change Over Background CD4+ cells | Maximum Frequency of TNFα/IFNγ Double Positive CD4+ T cells |
|---|---|---|---|---|
| AS18 (C2-NO1) | 9.17 | 0.110 | 7.51 | 0.053 |
| P87 (C2-NO4) | 9.20 | 0.460 | 7.86 | 0.110 |
| AS55 (C2-NO5) | 1354.17 | 32.500 | 19.38 | 0.310 |
| AS57 (C2-NO6) | 4.67 | 0.056 | 11.00 | 0.110 |
| AS15 (C2-NO11) | 4.36 | 0.061 | 9.17 | 0.110 |
| AS7 (C2-NO13) | 52.60 | 2.630 | 2.50 | 0.045 |
| AS43 (C2-NO15) | 28.75 | 0.460 | 5.67 | 0.040 |
| AS51 (C2-NO17) | 33.13 | 0.530 | 8.75 | 0.140 |
| AS16 (C2-NO19) | 24.17 | 0.290 | 7.78 | 0.140 |
| AS41 (C2-NO20) | 190.60 | 9.530 | 2.20 | 0.022 |
| AS6 (C2-NO22) | 6.50 | 0.078 | 31.67 | 0.380 |
| AS3 (C2-NO23) | 7.92 | 0.095 | 3.86 | 0.054 |
| AS11 | 5.11 | 0.07 | 2.98 | 0.03 |
| AS13 | 1.67 | 0.10 | 1.96 | 0.05 |
| AS47 (C2-NO30) | 4.80 | 0.240 | 2.58 | 0.031 |
| AS8 (C2-NO33) | 54.55 | 0.600 | 4.08 | 0.049 |
| AS19 | 5.87 | 0.63 | 2.59 | 0.1 |
| AS37 | 19.47 | 0.74 | 7.51 | 0.04 |
| AS23 | 3.24 | 0.07 | 5.08 | 0.01 |
| MS1 | 5.56 | 0.1 | 50.19 | 0.39 |
| MS3 | 36.15 | 0.47 | 13.61 | 0.09 |
| MS6 | 4.17 | 0.08 | 111.97 | 0.87 |
| MS8 | 4.44 | 0.14 | 15.60 | 0.40 |
| P82 | 2.92 | 0.09 | 4.44 | 0.17 |
| P16 (C2-NO8) | 2.44 | 0.039 | 2.44 | 0.039 |
| FUS1 (C2-NO9) | 1.94 | 0.031 | 8.33 | 0.100 |
| P22 (C2-NO10) | 1.56 | 0.025 | 18.16 | 0.075 |
| FUS2 (C2-NO14) | 3.13 | 0.05 | 2.14 | 0.03 |
| FUS3 (C2-NO21) | 3.94 | 0.063 | 2.75 | 0.033 |
| FUS6 (C2-NO28) | 3.50 | 0.056 | 2.27 | 0.016 |
| FUS5 (C2-NO32) | 32.50 | 0.390 | 3.43 | 0.048 |
| FUS8 | 1.89 | 0.08 | 7.15 | 0.04 |
| FUS15 (C2-NO35) | 1.75 | 0.028 | 2.79 | 0.039 |
| P35 | 14.44 | 0.26 | 3.47 | 0.03 |
| FUS19(C2-NO37) | 1.88 | 0.030 | 3.15 | 0.013 |
| FUS7 | 8.89 | 0.16 | 36.13 | 0.04 |
| M84 | 1.39 | 0.03 | 35.84 | 0.31 |
| M86 | 4.22 | 0.08 | 6.18 | 0.05 |

TABLE 25-continued

| Neoantigen ID (Alternative name) | Maximum Fold Change Over Background CD8+ cells | Maximum Frequency of TNFα/IFNγ Double Positive CD8+ T cells | Maximum Fold Change Over Background CD4+ cells | Maximum Frequency of TNFα/IFNγ Double Positive CD4+ T cells |
|---|---|---|---|---|
| M10 | 1.89 | 0.09 | 14.14 | 0.1 |
| M12 | 6.67 | 0.12 | 8.94 | 0.05 |
| FR1 | 7.92 | 0.38 | 4.89 | 0.04 |

TABLE 26

| Neoantigen ID (alternative name) | Overlapping Peptide Sequences* (SEQ ID NO:) |
|---|---|
| AS18 (C2-NO1) | WKFEMSYTVGGPPPH (560)<br>VGGPPPHVHARPRHW (561)<br>PPHVHARPRHWKTD (562) |
| P87 (C2-NO4) | YEAGMTLGGKILFFL (563)<br>GKILFFLFLLLPLSP (564)<br>FFLFLLLPLSPFSLIF (565) |
| AS55 (C2-NO5) | DGHSYTSKVNCLLLQ (566)<br>VNCLLLQDGFHGCVS (567)<br>GFHGCVSITGAAGRR (568)<br>TGAAGRRNLSIFLFL (569)<br>LSIFLFLMLCKLEFH (570)<br>LFLMLCKLEFHAC (571) |
| AS57 (C2-NO6) | TGGKSTCSAPGPQSL (572)<br>APGPQSLPSTPFSTY (573)<br>STPFSTYPQWVILIT (574) |
| AS15 (C2-NO11) | VLRFLDLKVRYLHS (269) |
| AS7 (C2-NO13) | DYWAQKEKGSSSFLR (576)<br>QKEKGSSSFLRPSC (577) |
| AS43 (C2-NO15) | VPFRELKNVSVLEGL (578)<br>VSVLEGLRQGRLGGP (579)<br>QGRLGGPCSCHCPRP (580)<br>SCHCPRPSQARLTPV (581)<br>QARLTPVDVAGPFLC (582)<br>VAGPFLCLGDPGLFP (583)<br>GDPGLFPPVKSSI (584) |
| AS51 (C2-NO17) | GMECTLGQVGAPSPR (585)<br>VGAPSPRREEDGWRG (586)<br>EEDGWRGGHSRFKAD (587)<br>HSRFKADVPAPQGPC (588)<br>PAPQGPCWGGQPGSA (589)<br>GGQPGSAPSSAPPEQ (590)<br>GSAPSSAPPEQSLLD (591) |
| AS16 (C2-NO19) | GNTTLQQLGEASQAP (592)<br>GEASQAPSGSLIPLR (593)<br>GSLIPLRLPLLWEVRG (594) |
| AS41 (C2-NO20) | EAFQRAAGEGGPGRG (595)<br>EGGPGRGGARRGARV (596)<br>ARRGARVLQSPFCRA (597)<br>QSPFCRAGAGEWLGH (598)<br>CRAGAGEWLGHQSLR (599) |
| AS6 (C2-NO22) | DYWAQKEKISIPRTH (600)<br>QKEKISIPRTHLC (601) |
| AS3 (C2-NO23) | VAMMVPDRQVHYDFG (602)<br>VPDRQVHYDFGLR (603) |
| AS11 | VPFRELKNQRTAQGA (631)<br>QRTAQGAPGIHHAAS (632)<br>GIHHAASPVAANLCD (633)<br>VAANLCDPARHAQHT (634)<br>ARHAQHTRIPCGAGQ (635)<br>IPCGAGQVRAGRGPE (636) |

TABLE 26-continued

| Neoantigen ID (alternative name) | Overlapping Peptide Sequences* (SEQ ID NO:) |
|---|---|
| | RAGRGPEAGGGVLQP (637)<br>GGGVLQPQRPAPEKP (638)<br>RPAPEKPGCPCRRGQ (639)<br>CPCRRGQPRLHTVKM (640)<br>RGQPRLHTVKMWRA (641) |
| AS13 | KRSFAVTERII (265) |
| AS47 (C2-NO30) | FKKFDGPCGERGGGR (604)<br>GERGGGRTARALWAR (605)<br>ARALWARGDSVLTPA (606)<br>DSVLTPALDPQTPVR (607)<br>DPQTPVRAPSLTRAA (608)<br>PVRAPSLTRAAAAV (609) |
| AS8 (C2-NO33) | LVLGVLSGHSGSRL (255) |
| AS19 | QWQHYHRSGEAAGTP (710)<br>GEAAGTPLWRPTRN (711) |
| AS37 | CHLFLQPQVGTPPPH (642)<br>VGTPPPHTASARAPS (643)<br>ASARAPSGPPHPHES (644)<br>PPHPHESCPAGRRPA (645)<br>PAGRRPARAAQTCAR (646)<br>AAQTCARRQHGLPGC (647)<br>QHGLPGCEEAGTARV (648)<br>EAGTARVPSLHLHLH (649)<br>SLHLHLHQAALGAGR (650)<br>AALGAGRGRGWGEAC (651)<br>RGWGEACAQVPPSRG (652) |
| AS23 | KIQNKNCPD (285) |
| MS1 | HYKLIQQPISLFSIT (653)<br>ISLFSITDRLHKTFS (654)<br>RLHKTFSQLPSVHLC (655)<br>LPSVHLCSITFQWGH (656)<br>ITFQWGHPPIFCSTN (657)<br>PIFCSTNDICVTANF (658)<br>ICVTANFCISVTFLK (659)<br>ISVTFLKPCFLLHEA (660)<br>CFLLHEASASQ (661) |
| MS3 | RTALTHNQDFSIYRL (662)<br>DFSIYRLCCKRGSLC (663)<br>CKRGSLCHASQARSP (664)<br>ASQARSPAFPKPVRP (665)<br>FPKPVRPLPAPITRI (666)<br>PAPITRITPQLGGQS (667)<br>PQLGGQSDSSQPLLT (668)<br>SSQPLLTTGRPQGWQ (669)<br>GRPQGWQDQALRHTQ (670)<br>QALRHTQQASPASCA (671)<br>ASPASCATITIPIHS (672)<br>ITIPIHSAALGDHSG (673)<br>ALGDHSGDPGPAWDT (674)<br>PGPAWDTCPPLPLTT (675)<br>PPLPLTTLIPRAPPP (676)<br>IPRAPPPYGDSTARS (677)<br>GDSTARSWPSRCGPLG (678) |

TABLE 26-continued

| Neoantigen ID (alternative name) | Overlapping Peptide Sequences* (SEQ ID NO:) |
|---|---|
| MS6 | YAYKDFLWCFPFSLV (679)<br>CFPFSLVFLQEIQIC (680)<br>LQEIQICCHVSCLCC (681)<br>HVSCLCCICCSTRIC (682)<br>CCSTRICLGCLLELF (683)<br>GCLLELFLSRALRAL (684)<br>SRALRALHVLWNGFQ (685)<br>VLWNGFQLHCQ (686) |
| MS8 | TMPAILKLQKNCLLSL (444) |
| P82 | YEAGMTLGEKFRVGN (687)<br>EKFRVGNCKHLKMTRP (688) |
| P16 (C2-NO8) | GVPGDSTRRAVRRMN (611)<br>DSTRRAVRRMNTF (612) |
| FUS1 (C2-NO9) | CGASACDVSLIAMDSA (211) |
| P22 (C2-NO10) | SLYHREKQLIAMDSAI (349) |
| FUS2 | TEYNQKLQVNQFSESK (712) |
| FUS3 (C2-NO21) | TEISCCTLSSEENEY (615)<br>SSEENEYLPRPEWQLQ (616) |
| FUS6 (C2-NO28) | CEERGAAGSLISCE (221) |
| FUSS (C2-NO32) | NSKMALNSEALSVVSE (219) |
| FUS8 | WGMELAASRRFSWDH (689)<br>RRFSWDHHSAGGPPR (690)<br>SAGGPPRVPSVRSGA (691)<br>PSVRSGAAQVQPKDP (692)<br>QVQPKDPLPLRTLAG (693)<br>PLRTLAGCLARTAHL (694)<br>LARTAHLRPGAESLP (695)<br>PGAESLPQPQLHCT (696) |
| FUS15 (C2-NO35) | HVVGYGHLDTSGSSS (619)<br>YGHLDTSGSSSSSSWP (620) |
| P35 | NSKMALNSLNSIDDA (697)<br>LNSIDDAQLTRIAPP (698)<br>LTRIAPPRSHCCFWE (699)<br>APPRSHCCFWEVNAP (700) |
| FUS19 (C2-NO37) | KMHFSLKEHPPPPCPP (235) |

TABLE 26-continued

| Neoantigen ID (alternative name) | Overlapping Peptide Sequences* (SEQ ID NO:) |
|---|---|
| FUS7 | LWFQSSELSPTGAPW (701)<br>SPTGAPWPSRRPTWR (702)<br>SRRPTWRGTTVSPRT (703)<br>TTVSPRTATSSARTC (704)<br>TSSARTCCGTKWPSS (705)<br>GTKWPSSQEAALGLG (706)<br>EAALGLGSGLLRFSC(707)<br>GLLRFSCGTAAIR (708) |
| M84 | IARELHQFAFDLLIKSH (167) |
| M86 | QPDSFAALHSSLNELGE (171) |
| M10 | FVQGKDWGLKKFIRRDF (19) |
| M12 | FVQGKDWGVKKFIRRDF (23) |
| FR1 | QNLQNGGGSRSSATL (709)<br>SRSSATLPGRRRRRW (575)<br>GRRRRRWLRRRRQPI (610)<br>RRRRQPISVAPAGPP (613)<br>VAPAGPPRRPNQKPN (614)<br>RPNQKPNPPGGARCV (617)<br>PGGARCVIMRPTWPG (618)<br>MRPTWPGTSAFT (621) |

Example 11 Neoantigens Incorporated into NeoGAd20 and NeoMVA are Immunogenic when Expressed Endogenously In Vitro For three of the neoantigens, an Ad5 vector was designed to transduce normal Dendritic cells with the neoantigens. This assay assessed the ability of the endogenously expressed and presented neoantigens to activate autologous T cells following overlapping 15-mer peptide pools restimulation using the endogenous autologous normal donor restimulation assay described in Example 1 utilizing TNFα and IFNγ production by $CD8^+$ and $CD4^+$ T cells as a readout. Table 27 shows the maximum frequency of $TNF\alpha^+IFN\gamma^+$ $CD8^+$ and $TNF\alpha^+IFN\gamma^+CD4^+$ T cells and maximum fold change over negative control for the pool of peptides analyzed, indicating the highest frequency of $TNF\alpha^+IFN\gamma^+$ $CD8^+$ and $TNF\alpha^+IFN\gamma^+CD4^+$ T cells and resulting fold change across the normal donors evaluated for the peptide. Sixteen donors were used to assess endogenous immunogenicity.

TABLE 27

| Neoantigen ID | Overlapping Peptide Sequences* (SEQ ID NO:) | Maximum Fold Change Over Background CD8+ cells | Maximum Frequency of TNFα/IFNγ Double Positive CD8+ T cells | Maximum Fold Change Over Background CD4+ cells | Maximum Frequency of TNFα/IFNγ Double Positive CD4+ T cells |
|---|---|---|---|---|---|
| AS18 (C2-NO1) | WKFEMSYTVGGPPPH (560)<br>VGGPPPHVHARPRHW (561)<br>PPHVHARPRHWKTD (562) | 4.09 | 0.36 | 1.90 | 0.046 |
| P87 (C2-NO4) | YEAGMTLGGKILFFL (563)<br>GKILFFLFLLLPLSP (564)<br>FFLFLLLPLSPFSLIF (565) | 2.47 | 0.39 | 2.41 | 0.079 |

TABLE 27-continued

| Neoantigen ID | Overlapping Peptide Sequences* (SEQ ID NO:) | Maximum Fold Change Over Background CD8+ cells | Maximum Frequency of TNFα/IFNγ Double Positive CD8+ T cells | Maximum Fold Change Over Background CD4+ cells | Maximum Frequency of TNFα/IFNγ Double Positive CD4+ T cells |
|---|---|---|---|---|---|
| AS55 (C2-NO5) | DGHSYTSKVNCLLLQ (566) VNCLLLQDGFHGCVS (567) GFHGCVSITGAAGRR (568) TGAAGRRNLSIFLFL (569) LSIFLFLMLCKLEFH (570) LFLMLCKLEFHAC (571) | 213.88 | 2.05 | 3.50 | 0.063 |

*All generated peptides had NH2 group at N-terminus and —OH group at C-terminus

Example 12: Neoantigens are Immunogenic In Vitro

Immunogenicity of various additional identified neoantigens was assessed. Overlapping 15-mer peptides were designed to span each neoantigen similarly to what was done in Example 11 to assess their ability to activate T cells using the exogenous autologous normal donor restimulation assay described in Example 1 as pools using TNFα and IFNγ production by $CD8^+$ and $CD4^+$ T cells as a readout. Table 28 shows the maximum frequency of $TNF\alpha^+IFN\gamma^+CD8^+$ and $TNF\alpha^+IFN\gamma^+CD4^+$ T cells and maximum fold change over negative control for the pool of peptides analyzed, indicating the highest frequency of $TNF\alpha^+IFN\gamma^+CD8^+$ and $TNF\alpha^+IFN\gamma^+CD4^+$ T cells and resulting fold change across the normal donors evaluated for the peptide. Table 29 shows the amino acid sequences of the peptides used in the assays for each neoantigen.

TABLE 28

| Neoantigen ID (Alternative name) | Max. Fold Change over background CD8+ TNFαINFγ double positive DP | Max. Frequency of CD8+ TNFαINFγ DP | Max. Fold Change over background CD4+ TNFαINFγ double positive DP | Max. Frequency of CD4+ TNFαINFγ DP |
|---|---|---|---|---|
| AS1 (Misc1-NO12) | 8.15 | 0.11 | 3.57 | 0.02 |
| AS2 (Misc1-NO13) | 5.06 | 0.09 | 110.68 | 0.86 |
| AS4 (Misc1-NO14) | 5.4 | 0.17 | 37.38 | 1.43 |
| AS5 (Misc1-NO15) | 2.13 | 0.16 | 8.71 | 0.1 |
| AS9 (Misc1-NO16) | 3.81 | 0.12 | 4.18 | 0.16 |
| AS10 (Misc1-NO17) | 4.33 | 0.08 | 3.97 | 0.23 |
| AS12 (Misc1-NO18) | 6.03 | 0.19 | 7.32 | 0.28 |
| AS14 (Misc1-NO19) | 3.81 | 0.12 | 1.49 | 0.06 |
| AS17 (Misc1-NO20) | 2.38 | 0.07 | 3.18 | 0.01 |
| AS20 (Misc1-NO21) | 3.81 | 0.12 | 1.36 | 0.05 |
| AS21 (Misc1-NO22) | 3.81 | 0.12 | 1.7 | 0.07 |
| AS22 (Misc1-NO23) | 2.61 | 0.1 | 7.86 | 0.11 |
| AS32 (Misc1-NO24) | 3.81 | 0.12 | 2.04 | 0.08 |
| AS34 (Misc1-NO26) | 16.25 | 0.26 | 9.48 | 0.01 |
| AS35 (Misc1-NO27) | 11.32 | 0.43 | 60.93 | 0.23 |
| AS36 (Misc2-NO1) | 1544.74 | 58.7 | 129.8 | 0.49 |
| AS40 (Misc2-NO3) | 178.52 | 2.41 | 15.34 | 0.89 |
| AS42 (Misc2-NO4) | 4.65 | 0.69 | 24.58 | 0.59 |
| AS44 (Misc2-NO5) | 4.72 | 0.09 | 293.94 | 1.48 |
| AS45 (Misc2-NO6) | 4.96 | 0.07 | 78.51 | 0.61 |
| AS46 (Misc2-NO7) | 11.6 | 0.87 | 157.98 | 0.29 |
| AS48 (Misc2-NO8) | 9.21 | 0.29 | 13.45 | 0.13 |
| AS49 (Misc2-NO9) | 8.67 | 0.65 | 184.87 | 0.14 |
| AS50 (Misc2-NO10) | 1.6 | 0.12 | 17.22 | 0.07 |
| AS52 (Misc2-NO11) | 6.85 | 0.1 | 184.87 | 0.63 |
| AS53 (Misc2-NO12) | 4.02 | 0.35 | 113.91 | 0.43 |
| AS54 | 88.15 | 8.33 | 17.87 | 0.18 |
| AS55.1 (Misc2-NO14) | 25.26 | 1.47 | 20.66 | 0.08 |
| AS56 | 6.35 | 0.6 | 128.76 | 0.18 |
| AS58 (Misc2-NO16) | 4.54 | 0.6 | 6.27 | 0.24 |
| AS59 (Misc2-NO17) | 4.22 | 0.08 | 59.58 | 0.3 |
| FUS9 (Misc1-NO2) | 1.82 | 0.07 | 203.97 | 0.77 |
| FUS10 (Misc1-NO3) | 2.42 | 0.09 | 10.86 | 0.04 |
| FUS11 (Misc1-NO4) | 2.63 | 0.1 | 28.57 | 0.16 |

TABLE 28-continued

| Neoantigen ID (Alternative name) | Max. Fold Change over background CD8+ TNFαINFγ double positive DP | Max. Frequency of CD8+ TNFαINFγ DP | Max. Fold Change over background CD4+ TNFαINFγ double positive DP | Max. Frequency of CD4+ TNFαINFγ DP |
|---|---|---|---|---|
| FUS18 | 42.33 | 0.91 | 31.76 | 0.04 |
| FUS23 (Misc1-NO6) | 11.05 | 0.62 | 12.77 | 0.12 |
| FUS24 (Misc1-NO7) | 8.53 | 0.64 | 4.4 | 0.05 |
| MS2 (Excl-NO6) | 36.92 | 0.48 | 15.12 | 0.1 |
| MS4 (Excl-NO8) | 24.13 | 0.76 | 367.35 | 2.43 |
| MS5 (Excl-NO9) | 32.89 | 1.95 | 126.05 | 0.2 |
| MS7 (Excl-NO11) | 6.67 | 0.12 | 10.52 | 0.09 |
| MS9 (Excl-NO13) | 1.38 | 0.1 | 455.63 | 1.72 |
| MS10 (Excl-NO14) | 3.42 | 0.13 | 74.17 | 0.28 |
| MS11 (Excl-NO15) | 3.81 | 0.12 | 3.4 | 0.13 |
| P97 (Misc1-NO11) | 7.47 | 1.11 | 3.14 | 0.12 |
| P19 (Misc1-NO8) | 4.76 | 0.15 | 6.67 | 0.16 |
| P27 (Misc1-NO9) | 7.87 | 0.59 | 45.38 | 0.05 |
| P37 (Misc1-NO10) | 2.05 | 0.13 | 22.78 | 0.09 |
| P76, P77 (Misc2-NO18) | 4.56 | 0.08 | 53.18 | 0.36 |

TABLE 29

| Neoantigen ID (Alternative name) | Peptide sequences |
|---|---|
| AS1 (Misc1-NO12) | LTFLDFIQVTLRVMS (SEQ ID NO: 377) |
| | VTLRVMSGSQMENGS (SEQ ID NO: 378) |
| | SQMENGSSYFFKPFS (SEQ ID NO: 415) |
| | YFFKPFSWGLGVGLS (SEQ ID NO: 417) |
| AS2 (Misc1-NO13) | FMIGELVGELCCQLT (SEQ ID NO: 418) |
| | ELCCQLTFRLPFLES (SEQ ID NO: 419) |
| | RLPFLESLCQAVVTQ (SEQ ID NO: 420) |
| | CQAVVTQALRFNPSF (SEQ ID NO: 502) |
| | LRFNPSFQEVCIYQD (SEQ ID NO: 518) |
| | EVCIYQDTDLM (SEQ ID NO: 526) |
| AS4 (Misc1-NO14) | WCPLDLRLGSTGCLT (SEQ ID NO: 527) |
| | GSTGCLTCRHHQTSHE (SEQ ID NO: 714) |
| AS5 (Misc1-NO15) | VVGRRHETAPQPLLV (SEQ ID NO: 715) |
| | APQPLLVPDRAGGEG (SEQ ID NO: 716) |
| | DRAGGEGGA (SEQ ID NO: 717) |
| AS9 (Misc1-NO16) | PVPTATPGVRSVTSP (SEQ ID NO: 718) |
| | VRSVTSPQGLGLFLK (SEQ ID NO: 719) |
| | GLGLFLKFI (SEQ ID NO: 720) |
| AS10 (Misc1-NO17) | KENDVREVCDVYLQM (SEQ ID NO: 721) |
| | CDVYLQMQIFFHFKF (SEQ ID NO: 722) |
| | IFFHFKFRSYFH (SEQ ID NO: 723) |
| AS12 (Misc1-NO18) | FARKMLEKVHRQHLQ (SEQ ID NO: 724) |
| | VHRQHLQLSHNSQE (SEQ ID NO: 725) |
| AS14 (Misc1-NO19) | MFLRKEQQVGPHSFS (SEQ ID NO: 726) |
| | VGPHSFSML (SEQ ID NO: 727) |
| AS17 (Misc1-NO20) | GLNLNTDRPGGYSYS (SEQ ID NO: 728) |
| | PGGYSYSIWWKNNAK (SEQ ID NO: 729) |
| | WWKNNAKNR (SEQ ID NO: 730) |
| AS20 (Misc1-NO21) | KVLNEIDAVVTVPPS (SEQ ID NO: 731) |
| | VVTVPPSLSTSQIPQ (SEQ ID NO: 732) |
| | STSQIPQGCCIIL (SEQ ID NO: 733) |
| AS21 (Misc1-NO22) | ANLKGTLQVRSGQAV (SEQ ID NO: 734) |
| | VRSGQAVSPR (SEQ ID NO: 735) |
| AS22 (Misc1-NO23) | LQAAASGQGKQGVPC (SEQ ID NO: 736) |
| | GKQGVPCPWGCCAYA (SEQ ID NO: 737) |
| | WGCCAYAESPRALIS (SEQ ID NO: 738) |

TABLE 29-continued

| Neoantigen ID (Alternative name) | Peptide sequences |
|---|---|
| | SPRALISGDAPSQVE (SEQ ID NO: 739) |
| | DAPSQVEREVPGPCL (SEQ ID NO: 740) |
| | EVPGPCLNTHSLSHR (SEQ ID NO: 741) |
| | THSLSHRSPQLPGLP (SEQ ID NO: 742) |
| | PQLPGLPHPKQPSV (SEQ ID NO: 743) |
| AS32 (Misc1-NO24) | GEVELSEGGEGQRHL (SEQ ID NO: 744) |
| | GEGQRHLAFPWACSG (SEQ ID NO: 745) |
| | FPWACSGPGWRGVCC (SEQ ID NO: 746) |
| | GWRGVCCAAVEPA (SEQ ID NO: 980) |
| AS34 (Misc1-NO26) | KMRAIQAEGGHGQAC (SEQ ID NO: 747) |
| | GGHGQACCGGAWGWA (SEQ ID NO: 748) |
| | GGAWGWAPGDGGPQG (SEQ ID NO: 749) |
| | GDGGPQGMLTHTLPT (SEQ ID NO: 750) |
| | LTHTLPTLGFQSAWT (SEQ ID NO: 751) |
| | GFQSAWTWRREDADR (SEQ ID NO: 752) |
| | RREDADRAWRTPKAC (SEQ ID NO: 753) |
| | WRTPKACASRRWSI (SEQ ID NO: 754) |
| AS35 (Misc1-NO27) | LLEPFRRGEPGPRGL (SEQ ID NO: 755) |
| | EPGPRGLLSGSSRGG (SEQ ID NO: 756) |
| | SGSSRGGEGPGRSIE (SEQ ID NO: 757) |
| | GPGRSIEAAPATPLP (SEQ ID NO: 758) |
| | APATPLPCCRKNPCR (SEQ ID NO: 759) |
| | CRKNPCRPQPSRFLP (SEQ ID NO: 760) |
| | QPSRFLPPRVLLVII (SEQ ID NO: 761) |
| | RVLLVIILPKLDCPK (SEQ ID NO: 762) |
| | PKLDCPKLGF (SEQ ID NO: 763) |
| AS36 (Misc2-NO1) | PSGRRTKRLVTLRSG (SEQ ID NO: 764) |
| | LVTLRSGCAIQCWHP (SEQ ID NO: 765) |
| | AIQCWHPRAGPVPSA (SEQ ID NO: 766) |
| | AGPVPSALPHTERPP (SEQ ID NO: 767) |
| | PHTERPPRLVRGAAD (SEQ ID NO: 768) |
| | LVRGAADPRTVTLGR (SEQ ID NO: 769) |
| | RTVTLGRSPAVMPRA (SEQ ID NO: 770) |
| | PAVMPRAPA (SEQ ID NO: 771) |
| AS40 (Misc2-NO3) | DCMLSEEGGQARRGG (SEQ ID NO: 772) |
| | GQARRGGSLCSLAAH (SEQ ID NO: 773) |
| | LCSLAAHTIASAARG (SEQ ID NO: 774) |
| | IASAARGRFLSRLSN (SEQ ID NO: 775) |
| | FLSRLSNFCAVVKAS (SEQ ID NO: 776) |
| | CAVVKASRGAPSCTWE (SEQ ID NO: 777) |

TABLE 29-continued

| Neoantigen ID (Alternative name) | Peptide sequences |
|---|---|
| AS42 (Misc2-NO4) | PEPRRLSPGEPRGRP (SEQ ID NO: 778)<br>GEPRGRPRKGWGIWG (SEQ ID NO: 779)<br>KGWGIWGLCGARVGP (SEQ ID NO: 780)<br>CGARVGPKAWR (SEQ ID NO: 781) |
| AS44 (Misc2-NO5) | FVSLTAIQMASSATP (SEQ ID NO: 782)<br>MASSATPWGRWPVAT (SEQ ID NO: 783)<br>GRWPVATPTAACPRR (SEQ ID NO: 784)<br>TAACPRRRPSSLPTG (SEQ ID NO: 785)<br>PSSLPTGGDSASKKP (SEQ ID NO: 786)<br>DSASKKPISRRAPWQ (SEQ ID NO: 787)<br>SRRAPWQPWACPGRS (SEQ ID NO: 788)<br>WACPGRSVNSAAPRA (SEQ ID NO: 789)<br>NSAAPRAWCPPATTP (SEQ ID NO: 790)<br>CPPATTPRTQSPSRD (SEQ ID NO: 791)<br>TQSPSRDLRPRCLSS (SEQ ID NO: 792)<br>RPRCLSSWSS (SEQ ID NO: 793) |
| AS45 (Misc2-NO6) | PVAIKPGTGPPNNSS (SEQ ID NO: 794)<br>GPPNNSSIHGGSKRS (SEQ ID NO: 795)<br>HGGSKRSENSYCRDL (SEQ ID NO: 796)<br>NSYCRDLRGQLRAIC (SEQ ID NO: 797)<br>GQLRAICCSSYSHDR (SEQ ID NO: 798)<br>SSYSHDRHTTEERGS (SEQ ID NO: 799)<br>TTEERGSRGRHVWRI (SEQ ID NO: 800)<br>GRHVWRIRRLHTSGL (SEQ ID NO: 801)<br>RLHTSGLPCCCHSGP (SEQ ID NO: 802)<br>CCCHSGPHPRRLPDI (SEQ ID NO: 803)<br>PRRLPDILRLVTSTK (SEQ ID NO: 804)<br>RLVTSTKTDHTNTTE (SEQ ID NO: 805)<br>DHTNTTEGTLDYL (SEQ ID NO: 806) |
| AS46 (Misc2-NO7) | KWNKNWTATLGALTI (SEQ ID NO: 807)<br>TLGALTIRGHKLLCH (SEQ ID NO: 808)<br>GHKLLCHLPHLLSSV (SEQ ID NO: 809)<br>PHLLSSVQQTCRSSSR (SEQ ID NO: 810) |
| AS48 (Misc2-NO8) | ENASLVFTGSNSPIP (SEQ ID NO: 811)<br>GSNSPIPACELSSHP (SEQ ID NO: 812)<br>CELSSHPAHGISPWI (SEQ ID NO: 813)<br>HGISPWIPSPGNEHF (SEQ ID NO: 814)<br>SPGNEHFHGIKKQVK (SEQ ID NO: 815)<br>GIKKQVKAIKVE (SEQ ID NO: 816) |
| AS49 (Misc2-NO9) | RLTQRLVQGWTPMEN (SEQ ID NO: 817)<br>GWTPMENRWCGRRAG (SEQ ID NO: 818)<br>WCGRRAGGQPASSST (SEQ ID NO: 819)<br>QPASSSTRWTTCRAA (SEQ ID NO: 820)<br>WTTCRAACLLTKWTA (SEQ ID NO: 821)<br>LLTKWTAGRSQTSIG (SEQ ID NO: 822) |
| AS50 (Misc2-NO10) | ENSGNASRWLHVPSS (SEQ ID NO: 823)<br>WLHVPSSSDDWLGWK (SEQ ID NO: 824)<br>DDWLGWKKSSAITSNS (SEQ ID NO: 825) |
| AS52 (Misc2-NO11) | KGSVERRSVSLGHPA (SEQ ID NO: 826)<br>VSLGHPAEGWAWAER (SEQ ID NO: 827)<br>GWAWAERSLQPGMTT (SEQ ID NO: 828)<br>LQPGMTTANTGCLSF (SEQ ID NO: 829)<br>NTGCLSFHHRGCLLP (SEQ ID NO: 830)<br>HRGCLLPVLPKLHCG (SEQ ID NO: 831)<br>LPKLHCGLGGLPLVR (SEQ ID NO: 832)<br>GGLPLVRAKEIKRVQ (SEQ ID NO: 833)<br>KEIKRVQRAGESSLP (SEQ ID NO: 834)<br>AGESSLPVKGLLTVA (SEQ ID NO: 835)<br>KGLLTVASAVIAVLW (SEQ ID NO: 836)<br>AVIAVLWGRPSEVTG (SEQ ID NO: 837)<br>RPSEVTGENEAQHD (SEQ ID NO: 838) |
| AS53 (Misc2-NO12) | FGLTTLAGRSSHGTS (SEQ ID NO: 839)<br>RSSHGTSGLRAATHT (SEQ ID NO: 840)<br>LRAATHTKSGDGGQG (SEQ ID NO: 841)<br>SGDGGQGAARQCEKL (SEQ ID NO: 842)<br>ARQCEKLLELARATR (SEQ ID NO: 843)<br>ELARATRPWGRSTSA (SEQ ID NO: 844)<br>WGRSTSASSRWTHRG (SEQ ID NO: 845)<br>SRWTHRGYMCPPRCA (SEQ ID NO: 846)<br>MCPPRCAVACW (SEQ ID NO: 847) |
| AS54 | IIDSDKIMAVCMGCL (SEQ ID NO: 848)<br>DKIMAVCMGCLLTRH (SEQ ID NO: 849)<br>AVCMGCLLTRHVQCQ (SEQ ID NO: 850)<br>GCLLTRHVQCQAMEM (SEQ ID NO: 851)<br>TRHVQCQAMEMQQ (SEQ ID NO: 852) |
| AS55.1 (Misc2-NO14) | DGHSYTSKVNCLLLQ (SEQ ID NO: 566)<br>VNCLLLQDGFHGCVS (SEQ ID NO: 567)<br>GFHGCVSITGAAGRR (SEQ ID NO: 568)<br>TGAAGRRNLSIFLFL (SEQ ID NO: 569)<br>LSIFLFLMLCKLEFHA (SEQ ID NO: 853) |
| AS56 | LLNAEDYRCAIHSKE (SEQ ID NO: 854)<br>CAIHSKEIYLLSPSP (SEQ ID NO: 855)<br>YLLSPSPHQAMDKFS (SEQ ID NO: 856)<br>QAMDKFSLCCINCNL (SEQ ID NO: 857)<br>CCINCNLCLHVFLLL (SEQ ID NO: 858)<br>LHVFLLLLFFQNKDV (SEQ ID NO: 859)<br>FFQNKDVWLISNIIL (SEQ ID NO: 860)<br>LISNIILLWIYGGI (SEQ ID NO: 861) |
| AS58 (Misc2-NO16) | VETLENANSFSSGIQ (SEQ ID NO: 862)<br>SFSSGIQPLLCSLIG (SEQ ID NO: 863)<br>LLCSLIGLENPT (SEQ ID NO: 864) |
| AS59 (Misc2-NO17) | AGAGTISEGSVLHGQ (SEQ ID NO: 865)<br>GSVLHGQRLECDARR (SEQ ID NO: 866)<br>LECDARRFFGCGTTI (SEQ ID NO: 867)<br>FGCGTTILAEWEHH (SEQ ID NO: 868) |
| FUS9 (Misc1-NO2) | KEQILAVASLVSSQS (SEQ ID NO: 869)<br>SLVSSQSIHPSWGQS (SEQ ID NO: 870)<br>HPSWGQSPLSRI (SEQ ID NO: 871) |
| FUS10 (Misc1-NO3) | LELELSEGVCFRLR (SEQ ID NO: 229) |
| FUS11 (Misc1-NO4) | QQLRIFCAAMASNED (SEQ ID NO: 872)<br>AMASNEDFS (SEQ ID NO: 873) |
| FUS18 | DGFSGSLFAVVTRRC (SEQ ID NO: 874)<br>AVVTRRCYFLKWRTI (SEQ ID NO: 875)<br>FLKWRTIFPQSLMWL (SEQ ID NO: 876) |
| FUS23 (Misc1-NO6) | DLRRVATYCAPLPSS (SEQ ID NO: 877)<br>CAPLPSSWRPGTGTT (SEQ ID NO: 878)<br>RPGTGTTIPPRMRSC (SEQ ID NO: 879) |
| FUS24 (Misc1-NO7) | LQERMELLACGAERG (SEQ ID NO: 880)<br>ACGAERGAGGWGGGG (SEQ ID NO: 881)<br>GGWGGGGGGGGGDRR (SEQ ID NO: 882)<br>GGGGDRRGGGGSAPA (SEQ ID NO: 883)<br>GGGSAPALADFAGGRG (SEQ ID NO: 884) |
| MS2 (Exc1-NO6) | WTDIVKQSVSTNCIS (SEQ ID NO: 885)<br>VSTNCISIKKGSYTK (SEQ ID NO: 886)<br>KKGSYTKLFSLVFLI (SEQ ID NO: 887)<br>FSLVFLIFCWPLIIQL (SEQ ID NO: 888) |
| MS4 (Exc1-NO8) | LRYGALCNVSRISYF (SEQ ID NO: 889)<br>VSRISYFSLTNIFNF (SEQ ID NO: 890)<br>LTNIFNFVIKSLTAI (SEQ ID NO: 891)<br>IKSLTAIFTVKF (SEQ ID NO: 548) |
| MS5 (Exc1-NO9) | RKERNIRKSESTLRL (SEQ ID NO: 892)<br>SESTLRLSPFPTPAP (SEQ ID NO: 893)<br>PFPTPAPSGAPAAAQ (SEQ ID NO: 894)<br>GAPAAAQGKVVRVPG (SEQ ID NO: 895)<br>KVVRVPGPAGGLVPR (SEQ ID NO: 896)<br>AGGLVPRDAGARLLP (SEQ ID NO: 897)<br>AGARLLPPAGGPGGG (SEQ ID NO: 898)<br>AGGPGGGAAAGEGRA (SEQ ID NO: 899)<br>AAGEGRAGRGRFPSI (SEQ ID NO: 900) |

TABLE 29-continued

| Neoantigen ID (Alternative name) | Peptide sequences |
|---|---|
| | RGRFPSITEPRPRDL (SEQ ID NO: 901)<br>EPRPRDLPPRVATGR (SEQ ID NO: 902)<br>PRVATGRRAGGRRKG (SEQ ID NO: 903)<br>AGGRRKGAGQGVRTR (SEQ ID NO: 904)<br>GQGVRTRPLPASWPG (SEQ ID NO: 905)<br>LPASWPGGRGPFRKG (SEQ ID NO: 906)<br>RGPFRKGPRRLPLGS (SEQ ID NO: 907)<br>RRLPLGSGPPAAGVQ (SEQ ID NO: 908)<br>PPAAGVQRLRCSHLS (SEQ ID NO: 909)<br>LRCSHLSRGPRRRRG (SEQ ID NO: 910)<br>GPRRRRGRVCGRACV (SEQ ID NO: 911)<br>VCGRACVSPPLPPRP (SEQ ID NO: 912)<br>PPLPPRPPPVGLSAE (SEQ ID NO: 913)<br>PVGLSAENLSWLSSG (SEQ ID NO: 914)<br>LSWLSSGLPRACSWR (SEQ ID NO: 915)<br>PRACSWREFSPETCA (SEQ ID NO: 916)<br>FSPETCAFRLSGLDS (SEQ ID NO: 917)<br>RLSGLDSKLSARVER (SEQ ID NO: 918)<br>LSARVERDLGALRAP (SEQ ID NO: 919)<br>LGALRAPGSRAAQGG (SEQ ID NO: 920)<br>SRAAQGGGRVRGSRS (SEQ ID NO: 921)<br>RVRGSRSEWKTRPWR (SEQ ID NO: 922)<br>WKTRPWRPPPAWPLT (SEQ ID NO: 923)<br>PPAWPLTRAGGPLPK (SEQ ID NO: 924)<br>AGGPLPKNPFLESCS (SEQ ID NO: 925)<br>PFLESCSETAQRRRV (SEQ ID NO: 926)<br>TAQRRRVFSFSTPLS (SEQ ID NO: 927) |
| MS7 (Exc1-NO11) | SINKATITGKKDLEL (SEQ ID NO: 928)<br>GKKDLELILHVSRKK (SEQ ID NO: 929)<br>LHVSRKKPFLPRVNI (SEQ ID NO: 930)<br>FLPRVNITPTPISCC (SEQ ID NO: 931)<br>PTPISCCNLKMLKKF (SEQ ID NO: 932)<br>LKMLKKFFLLYIIIS (SEQ ID NO: 933)<br>LLYIIISIIDLTNCL (SEQ ID NO: 934)<br>IDLTNCLSCYLEHFY (SEQ ID NO: 935)<br>CYLEHFYRFTFFTDV (SEQ ID NO: 936)<br>FTFFTDVHYF (SEQ ID NO: 937) |
| MS9 (Exc1-NO13) | PYYSALSGNSWVPST (SEQ ID NO: 938)<br>NSWVPSTLESDPFGY (SEQ ID NO: 939)<br>ESDPFGYVFSPLATR (SEQ ID NO: 940)<br>FSPLATRPALNDQES (SEQ ID NO: 941)<br>ALNDQESILWPTLTS (SEQ ID NO: 942)<br>LWPTLTSVVSCALSC (SEQ ID NO: 943)<br>VSCALSCPSLNLPEN (SEQ ID NO: 944)<br>SLNLPENWLTLITGG (SEQ ID NO: 945)<br>LTLITGGMKGGKKMK (SEQ ID NO: 946)<br>KGGKKMKFTFRH (SEQ ID NO: 947) |
| MS10 (Exc1-NO14) | GLRNLGNTVRAILLS (SEQ ID NO: 948)<br>VRAILLSFLSKRNVK (SEQ ID NO: 949)<br>LSKRNVKWCWGWGKP (SEQ ID NO: 950)<br>CWGWGKPTSLGKACG (SEQ ID NO: 951)<br>SLGKACGRRALKLF (SEQ ID NO: 952) |
| MS11 (Exc1-NO15) | MEAENAGSLHFHEVL (SEQ ID NO: 953)<br>LHFHEVLKMGHVKF (SEQ ID NO: 954) |
| P97 (Misc1-NO11) | GYLRMQGLMAQRLLLR (SEQ ID NO: 383) |
| P19 (Misc1-NO8) | WTPIPVLTRWPLPHP (SEQ ID NO: 955)<br>RWPLPHPPPWRRATS (SEQ ID NO: 956)<br>PWRRATSCRMARSSP (SEQ ID NO: 957)<br>RMARSSPSATSGSSV (SEQ ID NO: 958)<br>ATSGSSVRRRCSSLP (SEQ ID NO: 959)<br>RRCSSLPSWVWNLAA (SEQ ID NO: 960)<br>WVWNLAASTRPRSTPS (SEQ ID NO: 961) |
| P27 (Misc1-NO9) | LHPQRETFTPRWSGA (SEQ ID NO: 962)<br>TPRWSGANYWKLAFP (SEQ ID NO: 963)<br>YWKLAFPVGAEGTFP (SEQ ID NO: 964)<br>GAEGTFPAAATQRGV (SEQ ID NO: 965)<br>AATQRGVVRPA (SEQ ID NO: 966) |
| P37 (Misc1-NO10) | MAGGVLRRLLCREPD (SEQ ID NO: 967)<br>LLCREPDRDGDKGAS (SEQ ID NO: 968)<br>DGDKGASREETVVPL (SEQ ID NO: 969)<br>EETVVPLHIGDPVVL (SEQ ID NO: 970)<br>IGDPVVLPGIGQCYS (SEQ ID NO: 971)<br>GIGQCYSALF (SEQ ID NO: 972) |
| P76, P77 (Misc2-NO18) | VFFKRAAEGFFRMNK (SEQ ID NO: 973)<br>GFFRMNKLKESSDTN (SEQ ID NO: 974)<br>KESSDTNPKPYCMAA (SEQ ID NO: 975)<br>KPYCMAAPMGLTENN (SEQ ID NO: 976)<br>MGLTENNRNRKKSYR (SEQ ID NO: 977)<br>NRKKSYRETNLKAVS (SEQ ID NO: 978)<br>TNLKAVSWPLNHT (SEQ ID NO: 979) |

Example 13. Neoantigens Incorporated into VEEV Self-Replicating RNA are Immunogenic when Expressed Endogenously In Vitro Overlapping 15-mer peptides designed to span each neoantigen are inserted into VEEV replicon using EcoRV and AscI restriction sites. Their ability to activate T cells is assessed using the exogenous autologous normal donor restimulation assay described in Example 1. Pools using TNFα and IFNγ production by $CD8^+$ and $CD4^+$ T cells are used as a readout.

Example 14. Self-Replicating RNA is Encapsulated in Lipid Nanoparticles (LNP)

The self-replicating RNA was formulated as follows. The cationic lipid di((Z)-non-2-en-1-yl) 8,8'-((((2-(dimethylamino)ethyl)thio)carbonyl)azanediyl)dioctanoate, zwitterionic lipid DSPC, cholesterol and DMG-PEG 2000 were combined in ethanol in a lipid molar ratio (%) of 50:7:40:3 respectively. The lipid mix and the RNA were then combined using a microfluidic mixer from Precision Nanosystems, Inc to encapsulate the RNA in an LNP. The target N:P ratio is 9. Tangential Flow Filtration (TFF) was subsequently performed for buffer exchange and concentration of the LNP:RNA. The LNP formulated replicon RNA was stored at −80 C.

Example 15. Neoantigens Incorporated into Self-Replicating RNA Induce Cellular Response in Mice The purpose of these studies is to determine if the self-replicating RNA molecule (srRNA) encoding prostate neoantigens can prime an immune response that can be boosted by an Ad26, Gad20 or MVA vector and/or boost the immune response induced by a prime immunization with an Ad26 or Gad20 vector in Balb/c mice.

At Week 0, mice are immunized by IM injection with the RNA replicon formulated in an lipid nanoparticle (LNP), Ad26 or Gad20 vectors expressing the prostate neoantigens. At week 4, the animals are boosted as indicated in Table 30. Prime only control mice are immunized at Week 4. At Week 6, 2 weeks post boost, all animals are sacrificed and splenocytes are stimulated with peptide covering the antigen sequences in the prostate neoantigen insert. The induction of IFN-γ-producing cells is measured by IFN-γ ELISpot. CD8 and CD4 polyfunctional T cell responses are determined by measuring the production of IFN-γ, TNFα and IL-2 by flow cytometry. Table 30 shows the various experimental groups.

TABLE 30

| Group | Animal # | Description of groups |
|---|---|---|
| 1 | 5 | LNP buffer |
| 2 | 5 | srRNA/srRNA |
| 3 | 5 | Ad26/Ad26 |
| 4 | 5 | Gad20/Gad20 |
| 5 | 5 | Ad26/srRNA |
| 6 | 5 | Gad20/srRNA |
| 7 | 5 | Gad20/MVA |
| 8 | 5 | srRNA/Ad26 |
| 9 | 5 | srRNA/Gad20 |
| 10 | 5 | srRNA/MVA |
| 11 | 5 | srRNA prime only |
| 12 | 5 | Ad26 prime only |
| 13 | 5 | Gad20 prime only |

Example 16. Immunogenicity of srRNA and MVA-PC NeoAg or GAd20-PC NeoAg in Non-Human Primates (NHP)

The primary aim of this study is to determine whether vaccination with the disclosed srRNA and MVA-HCalJ-9.9 or srRNA and GAd20-PC NeoAg (Gad20 encoding Prostate Neoantigens) induces prostate cancer neo antigen specific T-cell responses that are higher in magnitude and duration than vaccination with srRNA or GAd20-PC NeoAg alone in NHP. The secondary aim is to evaluate if an anti-CTLA-4 monoclonal antibody i.e., YERVOY® (ipilimumab) ([Ipi]) in combination with srRNA and MVA-HCalJ-9.9 or srRNA and GAd20-PC NeoAg can enhance the vaccine induced immune response. In addition, an explorative objective is to evaluate if anti-PD-1 monoclonal antibodies OPDIVO® (nivolumab) in combination with vaccine regimen and anti-CTLA4 is comparable or increases insert-specific T-cell responses compared to animals dosed without anti-PD-1. Cynomolgus macaques are immunized IM with srRNA-, GAd20-PC NeoAg, and/or MVA-PC NeoAg alone or in combination with Ipi (3 mg/kg sub cutaneous [SC]) or in combination with Nivolumab (10 mg/kh intravenous [IV] according to schedule shown in Table 31. Briefly, NHPs are immunized with srRNA and MVA-HCalJ-9.9 or GAd20-PC NeoAg and srRNA (Group 1 and Group 2) in combination with Ipi 3 mg/kg SC (Group 3 and Group 4) or in combination with Ipi 3 mg/kg SC and Nivolumab IV 10 mg/kg IV (Group 5 and Group 6). Animals are bled at various time points and PBMCs and serum are isolated for immunological assays. The induction of immune responses specific to Prostate Cancer Neo antigens are evaluated in PBMCs at various time points during the study by IFN-γ Elispot using peptide pools comprised of 15mer overlapping peptides corresponding to the entire Prostate Neo antigen insert sequence or sub pools specific regions of the insert.

The srRNA vaccine is expected to elicit an antigen specific T cell response that can be further increased when administered as a regimen in combination with GAd20 PC Neo Ag or MVA PC Neo Ag. Use of immune checkpoint blockade monoclonal antibodies anti CTLA4 and/or anti PD-1 in combination with srRNA alone or as a vaccine regimen will lead to higher magnitude, quality, and more durable antigen specific T cell response.

TABLE 31

| | Prime/Boost | | IO Agent | | | |
|---|---|---|---|---|---|---|
| Group | Day 0 and Day 28 | Boost Day 70 | Day 0 | Day 28 | Day 70 | Day 29, Day 57, Day 84, Day 113 |
| 1 | srRNA/ srRNA | MVA | | | | — |
| 2 | GAd20/ GAd20 | srRNA | | | | |
| 2 | srRNA/ srRNA | MVA | αCTLA4 3 mpk sc | αCTLA4 3 mpk sc | αCTLA4 3 mpk sc | — |
| 3 | GAd20/ GAd20 | srRNA | αCTLA4 3 mpk sc | αCTLA4 3 mpk sc | αCTLA4 3 mpk sc | |
| | srRNA/ srRNA | MVA | αCTLA4 3 mpk sc | αCTLA4 3 mpk sc | αCTLA4 3 mpk sc | αPD1 10 mpk IV |
| 4 | GAd20/ GAd20 | srRNA | αCTLA4 3 mpk sc | αCTLA4 3 mpk sc | αCTLA4 3 mpk sc | αPD1 10 mpk IV |

In addition to evaluating the ability of srRNA vaccine to generate antigen specific T cell responses from a single administration, multi dose srRNA schedules will be explored. Multi-dose regimens are tested to evaluate if srRNA can maintain an antigen specific T cell response by administration on a monthly intramuscular dosing schedule. The effectiveness of the maintenance schedule is further evaluated by assessing antigen specific T cell response post GAd20 PC Neo Ag or srRNA, MVA PC Neo Ag combination vaccination.

One potential advantage of a srRNA based vaccine is the lack of vector specific immunity developed. Absence of vector specific immune response can allow for repeat dosing without diminishment of antigen presentation due to an inability of srRNA based vaccine to generate neutralizing antibodies specific to the vector. Multi dose srRNA based regimens are expected to elicit higher magnitude of T cell responses with a longer duration.

SEQ ID NO: 662

CATCATCAATAATATACCTTATTTTGGATTGAGGCCAATATGATAATGAGGTGGGCGGGGCGAGGCGGGGCGGGTGACGTAGGACGCGCGAGTAGGGTTGG

GAGGTGTGGCGGAAGTGTGGCATTTGCAAGTGGGAGGAGCTGACATGCAATCTTCCGTCGCGGAAAATGTGACGTTTTTGATGAGCGCCGCCTACCTCCGG

AAGTGCCAATTTTCGCGCGCTTTTCACCGGATATCGTAGTAATTTTGGGCGGGACCATGTAAGATTTGGCCATTTTCGCGCGAAAAGTGAAACGGGGAAGT

GAAAACTGAATAATAGGGCGTTAGTCATAGCGCGTAATATTTACCGAGGGCCGAGGGACTTTGACCGATTACGTGGAGGACTCGCCCAGGTGTTTTTTACG

TGAATTTCCGCGTTCCGGGTCAAAGTCTCCGTTTTTATTGTCGCCGTCATCTGACGCGGAGGGTATTTAAACCCGCTGCGCTCCTAAAGAGGCCACTCTTG

AGTGCCAGCGAGAAGAGTTTTCTCCTCCGCTCCGTTTCGGCGATCGAAAAATGAGACATTTAGCCTGCACTCCGGGTCTTTTGTCCGGCCGGGCGGCGTCC

GAGCTTTTGGACGCTTTGCTCAATGAGGTTCTGAGCGATGATTTTCCGTCTACTACCCACTTTAGCCCACCTACTCTTCACGAACTGTACGATCTGGATGT

ACTGGTGGATGTGAACGATCCCAACGAGGAGGCGGTTTCTACGTTTTTTCCCGAGTCTGCGCTTTTGGCTGCCCAGGAGGGATTTGACCTACACACTCCGC

CGCTGCCTATTTTAGAGTCTCCGCTGCCGGAGCCCAGTGGTATACCTTATATGCCTGAACTGCTTCCCGAAGTGGTAGACCTGACCTGCCACGAGCCGGGC

TTTCCGCCCAGCGACGATGAGGGTGAGCCTTTTGCTTTAGACTATGCTGAGATACCTGGGCTCGGTTGCAGGTCTTGTGCATATCATCAGAGGGTTACCGG

AGACCCCGAGGTTAAGTGTTCGCTGTGCTATATGAGGCTGACCTCTTCCTTTATCTACAGTAAGTTTTTTTGTGTAGGTGGGCTTTTTGGGTAGGTGGGTT

TTGTGGCAGGACAGGTGTAAATGTTGCTTGTGTTTTTTGTACCTGCAGGTCCGGTGTCCGAGCCAGACCCGGAGCCCGACCGCGATCCCGAGCCGGATCCC

GAGCCTCCTCGCAGGCCAAGGAAATTACCTTCCATTTTGTGCAAGCCTAAGACACCTGTGAGGACCAGCGAGGCGGACAGCACTGACTCTGGCACTTCTAC

CTCTCCTCCTGAAATTCACCCAGTGGTTCCTCTGGGTATACATAGACCTGTTGCTGTTAGAGTTTGCGGGCGACGCCCTGCAGTAGAGTGCATTGAGGACT

TGCTTAACGATCCCGAGGGACCTTTGGACTTGAGCATTAAACGCCCTAGGCAATAAACCCCACCTAAGTAATAAACCCCACCTAAGTAATAAACTTTACCG

CCCTTGGTTATTGAGATGACGCCCAATGTTTGCTTTTGAATGACTTCATGTGTATAATAAAAGTGAGTGTGGTCATAGGTCTCTTGTTTGTCTGGGCGGGG

TTTAAGGGTATATAAGTTTCTCGGGGCTAAACTTGGTTACACTTGACCCCAATGGAGGCGTGGGGGTGCTTGGAGGAGTTTGCGGACGTGCGCCGTTTGCT

GGACGAGAGCTCTAGCAATACCTATAGTATTTGGAGGTATCTGTGGGGCTCTACTCAGGCCAAGTTGGTCTTCAGAATTAAGCAGGATTACAAGTGCGATT

TTGAAGAGCTTTTTAGTTCCTGTGGTGAGCTTTTGCAATCCTTGAATCTGGGCCACCAGGCTATCTTCCAGGAAAAGGTTCTCTCGACTTTGGATTTTTCC

ACTCCCGGGCGCACCGCCGCTTGTGTGGCTTTTGTGTCTTTTGTGCAAGATAAATGGAGCGGGGAGACCCACCTGAGTCACGGCTACGTGCTGGATTTCAT

GGCGATGGCTCTTTGGAGGGCTTACAACAAATGGAAGATTCAGAAGGAACTGTACGGTTCCGCCCTACGTCGTCCACTTCTGCAGCGGCAGGGGCTGATGT

TTCCCGACCATCGCCAGCATCAGAATCTGGAAGACGAGCGAGCGGAGAAGATCAGCTTGAGAGCCGGCCTGGACCCTCCTCAGGAGGAATGAATCTCCCGC

AGGTGGTTGAGCTGTTTCCCGAACTGAGACGGGTCCTGACTATCAGGGAGGATGGTCAGTTTGTGAAGAAGCTGAAGAGGGATCGGGGTGAGGGAGATGAT

GAGGCGGCTAGCAATTTAGCTTTTAGTCTGATAACTCGCCACCGACCGGAATGTATTACCTATCAGCAGATTAAGGAGAGTTGTGCCAACGAGCTGGATCT

TTTGGGTCAGAAGTATAGCATAGAACAGCTTACCACTTACTGGCTTCAGCCCGGGGATGATTGGGAAGAGGCGATTAGGGTGTATGCAAAGGTGGCCCTGC

GGCCCGATTGCAAGTATAAGATTACTAAGTTGGTTAATATTAGAAACTGCTGCTATATTTCTGGAAACGGGGCCGAAGTGGAGATAGATACTGAGGACAGG

GTGGCTATTAGGTGTTGCATGATAAACATGTGGCCCGGGATACTGGGGATGGATGGGGTGATATTTATGAATGTGAGGTTCACGGGCCCCAACTTTAATGG

TACGGTGTTCATGGGCAACACCAACTTGCTCCTGCATGGTGCGAGTTTCTATGGGTTTAACAACACCTGTATAGAGGCCTGGACCGATGTAAAGGTTCGAG

GTTGTTCCTTTTATAGCTGTTGGAAGGCGGTGGTGTGTCGCCCTAAAAGCAGGGGTTCTGTGAAGAAATGCTTGTTTGAAAGGTGCACCCTAGGTATCCTT

TCTGAGGGCAACTCCAGGGTGCGCCATAATGTGGCTTCGAACTGCGGTTGCTTCATGCAAGTGAAGGGGGTGAGCGTTATCAAGCATAACTCGGTCTGTGG

AAACTGCGAGGATCGCGCCTCTCAGATGCTGACCTGCTTTGATGGCAACTGTCACCTGTTGAAGACCATTCATATAAGCAGTCACCCCAGAAAGGCCTGGC

CCGTGTTTGAGCATAACATTCTGACCCGCTGTTCCTTGCATCTGGGGGTCAGGAGGGGTATGTTCCTGCCTTACCAGTGTAACTTTAGCCACACTAAAATC

CTGCTGGAACCCGAGTGCATGACTAAGGTCAGCCTGAATGGTGTGTTTGATGTGAGTCTGAAGATTTGGAAGGTGCTGAGGTATGATGAGACCAGGACCAG

GTGCCGACCCTGCGAGTGCGGCGGCAAGCACATGAGAAATCAGCCTGTGATGTTGGATGTGACCGAGGAGCTTAGGCCTGACCATCTGGTGCTGGCCTGCA

CCAGGGCCGAGTTTGGGTCTAGCGATGAGGATACCGATTGAGGTGGGTAAGGTGGGCGTGGCTAGCAGGGTGGGCGTGTATAAATTGGGGGTCTAAGGGGT

CTCTCTGTTTGTCTTGCAACAGCCGCCGCCATGAGCGACACCGGCAACAGCTTTGATGGAAGCATCTTTAGTCCCTATCTGACAGTGCGCATGCCTCACTG

GGCCGGAGTGCGTCAGAATGTGATGGGTTCCAACGTGGATGGACGTCCCGTTCTGCCTTCAAATTCGTCTACTATGGCCTACGCGACCGTGGGAGGAACTC

CGCTGGACGCCGCGACCTCCGCCGCCGCCTCCGCCGCCGCCGCGACCGCGCGCAGCATGGCTACGGACCTTTACAGCTCTTTGGTGGCGAGCAGCGCGGCC

TCTCGCGCGTCTGCTCGGGATGAGAAACTGACTGCTCTGCTGCTTAAACTGGAAGACTTGACCCGGGAGCTGGGTCAACTGACCCAGCAGGTTTCCAGCTT

GCGTGAGAGCAGCCTTGCCTCCCCCTAATGGCCCATAATATAAATAAAAGCCAGTCTGTTTGGATTAAGCAAGTGTATGTTCTTTATTTAACTCTCCGCGC

-continued

GCGGTAAGCCCGGGACCAGCGGTCTCGGTCGTTTAGGGTGCGGTGGATTTTTTCCAACACGTGGTACAGGTGGCTCTGGATGTTTAGATACATGGGCATGA

GTCCATCCCTGGGGTGGAGGTAGCACCACTGCAGAGCTTCGTGCTCGGGGGTGGTGTTGTATATGATCCAGTCGTAGCAGGAGCGCTGGGCGTGGTGCTGA

AAAATGTCCTTAAGCAAGAGGCTTATAGCTAGGGGGAGGCCCTTGGTGTAAGTGTTTACAAATCTGCTTAGCTGGGAGGGGTGCATCCGGGGGGATATGAT

GTGCATCTTGGACTGGATTTTTAGGTTGGCTATGTTCCCGCCCAGATCCCTTCTGGGATTCATGTTGTGCAGGACCACCAGCACGGTATATCCAGTGCACT

TGGGAAATTTATCGTGGAGCTTAGACGGGAATGCATGGAAGAACTTGGAGACGCCCTTGTGGCCTCCCAGATTTTCCATACATTCGTCCATGATGATGGCA

ATGGGCCCGTGGGAAGCTGCCTGAGCAAAAACGTTTCTGGCATCGCTCACATCGTAGTTATGTTCCAGGGTGAGGTCATCATAGGACATCTTTACGAATCG

GGGGCGAAGGGTCCCGGACTGGGGGATGATGGTACCCTCGGGCCCCGGGGCGTAGTTCCCCTCACAGATCTGCATCTCCCAGGCTTTCATTTCAGAGGGAG

GGATCATATCCACCTGCGGGGCGATGAAAAAGACAGTTTCTGGCGCAGGGGAGATTAACTGGGATGAGAGCAGGTTTCTGAGCAGCTGTGACTTTCCACAG

CCGGTGGGCCCATATATCACGCCTATCACCGGCTGCAGCTGGTAGTTAAGAGAGCTGCAGCTGCCGTCCTCCCGGAGCAGGGGGGCCACCTCGTTGAGCAT

ATCCCTGACGTGGATGTTCTCCCTGACCAGTTCCGCCAGAAGGCGCTCGCCGCCCAGCGAAAGCAGCTCTTGCAAGGAAGCAAAATTTTTCAGCGGTTTCA

GGCCATCGGCCGTGGGCATGTTTTTCAGCGTCTGGGTCAGCAGCTCCAGCCTGTCCCAGAGCTCGGTGATGTGCTCTACGGCATCTCGATCCAGCAGATCT

CCTCGTTTCGCGGGTTGGGGCGGCTTTCGCTGTAGGGCACCAGCCGATGGGCGTCCAGCGGGGCCAGAGTCATGTCCTTCCATGGGCGCAGGGTCCTCGTC

AGGGTGGTCTGGGTCACGGTGAAGGGGTGCGCTCCGGGTTGGGCACTGGCCAGGGTGCGCTTGAGGCTGGTTCTGCTGGTGCTGAATCGCTGCCGCTCTTC

GCCCTGCGCGTCGGCCAGGTAGCATTTGACCATGGTCTCGTAGTCGAGACCCTCGGCGGCGTGCCCCTTGGCGCGGAGCTTTCCCTTGGAGGTGGCGCCGC

ACGAGGGGCACTGCAGGCTCTTCAGGGCGTAGAGCTTGGGAGCGAGAAACACGGACTCTGGGGAGTAGGCGTCCGCGCCGCAGGCCGAGCAGACCGTCTCG

CATTCCACCAGCCAAGTGAGTTCCGGGCGGTCAGGGTCAAAAACCAGGTTGCCCCCATGCTTTTTGATGCGTTTCTTACCTTGGCTCTCCATGAGGCGGTG

TCCCTTCTCGGTGACGAAGAGGCTGTCCGTGTCCCCGTAGACCGACTTCAGGGGCCTGTCTTCCAGCGGAGTGCCTCTGTCCTCCTCGTAGAGAAACTCTG

ACCACTCTGAGACGAAGGCCCGCGTCCAGGCCAGGACGAAGGAGGCCACGTGGGAGGGGTAGCGGTCGTTGTCCACTAGCGGGTCCACCTTCTCCAGGGTG

TGCAGGCACATGTCCCCCTCCTCCGCGTCCAGAAAAGTGATTGGCTTGTAGGTGTAGGACACGTGACCGGGGGTTCCCAACGGGGGGGTATAAAAGGGGGT

GGGTGCCCTTTCATCTTCACTCTCTTCCGCATCGCTGTCTGCGAGAGCCAGCTGCTGGGGTAAGTATTCCCTCTCGAAGGCGGGCATGACCTCAGCGCTCA

GGTTGTCAGTTTCTAAAAATGAGGAGGATTTGATGTTCACCTGTCCGGAGGTGATACCTTTGAGGGTACCTGGGTCCATCTGGTCAGAAAACACTATTTTT

TTGTTATCAAGCTTGGTGGCGAATGACCCGTAGAGGGCGTTGGAGAGCAGCTTGGCGATGGAGCGCAGGGTCTGGTTTTTGTCGCGGTCGGCTCGCTCCTT

GGCCGCGATGTTGAGTTGCACGTACTCGCGGGCCACGCACTTCCACTCGGGGAACACGGTGGTGCGCTCGTCTGGGATCAGGCGCACCCTCCAGCCGCGGT

TGTGCAGGGTGACCATGTCGACGCTGGTGGCGACCTCACCGCGCAGACGCTCGTTGGTCCAGCAGAGGCGGCCGCCCTTGCGCGAGCAGAAGGGGGGTAGG

GGGTCCAGCTGGTCCTCGTTTGGGGGGTCCGCGTCGATGGTAAAGACCCCGGGGAGCAGGCGCGGGTCAAAGTAGTCGATCTTGCAAGCTTGCATGTCCAG

AGCCCGCTGCCATTCGCGGGCGGCGAGCGCGCGCTCGTAGGGGTTGAGGGGCGGGCCCCAGGGCATGGGGTGGGTGAGCGCGGAGGCGTACATGCCGCAGA

TGTCATACACGTACAGGGGTTCCCTGAGGATACCGAGGTAGGTGGGGTAGCAGCGCCCCCCGCGGATGCTGGCGCGCACGTAGTCATAGAGCTCGTGGGAG

GGGGCCAGCATGTTGGGCCCGAGGTTGGTGCGCTGGGGGCGCTCGGCGCGGAAGACGATCTGCCTGAAGATGGCGTGGGAGTTGGAGGAGATGGTGGGCCG

CTGGAAGACGTTGAAGCTTGCTTCTTGCAAGCCCACGGAGTCCCTGACGAAGGAGGCGTAGGACTCGCGCAGCTTGTGCACCAGCTCGGCGGTGACCTGGA

CGTCGAGCGCACAGTAGTCGAGGGTCTCGCGGATGATGTCATACCTATCCTCCCCCTTCTTTTTCCACAGCTCGCGGTTGAGGACGAACTCTTCGCGGTCT

TTCCAGTACTCTTGGAGGGGAAACCCGTCCGTGTCCGAACGGTAAGAGCCTAGCATGTAGAACTGGTTGACGGCCTGGTAGGGGCAGCAGCCCTTCTCCAC

GGGCAGCGCGTAGGCCTGCGCCGCCTTGCGGAGGGAGGTGTGGGTGAGGGCGAAAGTGTCCCTGACCATGACTTTGAGGTATTGATGTCTGAAGTCTGTGT

CATCGCAGCCGCCCTGTTCCCACAGGGTGTAGTCCGTGCGCTTTTTGGAGCGCGGGTTGGGCAGGGAGAAGGTGAGGTCATTGAAGAGGATCTTCCCCGCT

CGAGGCATGAAGTTTCTGGTGATGCGAAAGGGCCCTGGGACCGAGGAGCGGTTGTTGATGACCTGGGCGGCCAGGACGATCTCGTCAAAGCCGTTTATGTT

GTGTCCCACGATGTAGAGCTCCAGGAAGCGGGGCTGGCCCTTGATGGAGGGGAGCTTTTTAAGTTCCTCGTAGGTAAGCTCCTCGGGCGATTCCAGGCCGT

GCTCCTCCAGGGCCCAGTCTTGCAAGTGAGGGTTGGCCGCCAGGAAGGATCGCCAGAGGTCGCGGGCCATGAGGGTCTGCAGGCGGTCGCGGAAGGTTCTG

AACTGCCGCCCCACGGCCATTTTTTCGGGGGTGATGCAGTAGAAGGTGAGGGGGTCTTTCTCCCAGGGGTCCCATCTGAGCTCTCGGGCGAGGTCGCGCGC

GGCAGCGACCAGAGCCTCGTCGCCCCCCAGTTTCATGACCAGCATGAAGGGCACGAGTTGCTTGCCAAAGGCTCCCATCCAAGTGTAGGTTTCTACATCGT

AGGTGACAAAGAGGCGCTCCGTGCGAGGATGAGAGCCGATTGGGAAGAACTGGATCTCCCGCCACCAGTTGGAGGATTGGCTGTTGATGTGGTGAAAGTAG

AAGTCCCGTCTGCGGGCCGAGCACTCGTGCTGGCTTTTGTAAAAGCGACCGCAGTACTGGCAGCGCTGCACGGGTTGTATATCTTGCACGAGGTGAACCTG

GCGACCTCTGACGAGGAAGCGCAGCGGGAATCTAAGTCCCCCGCCTGGGGTCCCGTGTGGCTGGTGGTCTTTTACTTTGGTTGTCTGGCCGCCAGCATCTG

-continued

TCTCCTGGAGGGCGATGGTGGAACAGACCACCACGCCGCGAGAGCCGCAGGTCCAGATCTCGGCGCTCGGCGGGCGGAGTTTGATGACGACATCGCGCACA

TTGGAGCTGTCCATGGTCTCCAGCTCCCGCGGCGGCAGGTCAGCCGGGAGTTCCTGGAGGTTCACCTCGCAGAGACGGGTCAAGGCGCGGACAGTGTTGAG

ATGGTATCTGATTTCAAGGGGCATGTTGGAGGCGGAGTCGATGGCTTGCAGGAGGCCGCAGCCCCGGGGGGCCACGATGGTTCCCCGCGGGGCGCGAGGGG

AGGCGGAAGCTGGGGGTGTGTTCAGAAGCGGTGACGCGGGCGGGCCCCCGGAGGTAGGGGGGGTTCCGGCCCCACAGGCATGGGCGGCAGGGGCACGTCTT

CGCCGCGCGCGGGCAGGGGCTGGTGCTGGCTCCGAAGAGCGCTTGCGTGCGCGACGACGCGACGGTTGGTGTCCTGTATCTGGCGCCTCTGAGTGAAGACC

ACGGGTCCCGTGACCTTGAACCTGAAAGAGAGTTCGACAGAATCAATCTCGGCATCGTTGACAGCGGCCTGGCGCAGGATCTCCTGCACGTCGCCCGAGTT

GTCCTGGTAGGCGATTTCTGCCATGAACTGCTCGATCTCTTCCTCCTGGAGATCTCCTCGTCCGGCGCGCTCCACGGTGGCCGCCAGGTCGTTGGAGATGC

GACCCATGAGCTGCGAGAAGGCGTTGAGTCCGCCCTCGTTCCAGACCCGGCTGTAGACCACGCCCCCCTCGGCGTCGCGGGCGCGCATGACCACCTGGGCC

AGGTTGAGCTCCACGTGTCGCGTGAAGACGGCGTAGTTGCGCAGGCGCTGGAAAAGGTAGTTCAGGGTGGTGGCGGTGTGCTCGGCGACGAAGAAGTACAT

GACCCAGCGCCGCAACGTGGATTCATTGATGTCCCCCAAGGCCTCCAGGCGCTCCATGGCCTCGTAGAAGTCCACGGCGAAGTTGAAAAACTGGGAGTTGC

GAGCGGACACGGTCAACTCCTCCTCCAGAAGACGGATGAGCTCGGCGACAGTGTCGCGCACCTCGCGCTCGAAGGCCACGGGGGGCGCTTCTTCCTCTTCC

ACCTCTTCTTCCATGATTGCTTCTTCTTCTTCCTCAGCCGGGACGGGAGGGGGCGGCGGCGGGGGAGGGGCGCGGCGGCGGCGGCGGCGCACCGGGAGGCG

GTCGATGAAGCGCTCGATCATCTCCCCCCGCATGCGGCGCATGGTCTCGGTGACGGCGCGGCCGTTCTCCCGGGGGCGCAGCTCGAAGACGCCGCCTCTCA

TTTCGCCGCGGGGCGGGCGGCCGTGAGGTAGCGAGACGGCGCTGACTATGCATCTTAACAATTGCTGTGTAGGTACGCCGCCAAGGGACCTGATTGAGTCC

AGATCCACCGGATCCGAAAACCTTTGGAGGAAAGCGTCTATCCAGTCGCAGTCGCAAGGTAGGCTGAGCACCGTGGCGGGCGGGGGCGGGTCGGGAGAGTT

CCTGGCGGAGATGCTGCTGATGATGTAATTAAAGTAGGCGGTCTTGAGAAGGCGGATGGTGGACAGGAGCACCATGTCTTTGGGTCCGGCCTGTTGGATGC

GGAGGCGGTCGGCCATGCCCCAGGCCTCGTTCTGACACCGGCGCAGGTCTTTGTAGTAATCTTGCATGAGTCTTTCCACCGGCACTTCTTCTCCTTCCTCT

TCTTCATCTCGCCGGTGGTTTCTCGCGCCGCCCATGCGCGTGACCCCAAAGCCCCTGAGCGGCTGCAGCAGGGCCAGGTCGGCGACCACGCGCTCGGCCAA

GATGGCCTGCTGTACCTGAGTGAGGGTCCTCTCGAAGTCATCCATGTCCACGAAGCGGTGGTAGGCACCCGTGTTGATGGTGTAGGTGCAGTTGGCCATGA

CGGACCAGTTGACGGTCTGGTGTCCCGGCTGCGAGAGCTCCGTGTACCGCAGGCGCGAGAAGGCGCGGGAATCGAACACGTAGTCGTTGCAAGTCCGCACC

AGATACTGGTAGCCCACCAGGAAGTGCGGCGGAGGTTGGCGATAGAGGGGCCAGCGCTGGGTGGCGGGGGCGCCGGGCGCCAGGTCTTCCAGCATGAGGCG

GTGGTATCCGTAGATGTACCTGGACATCCAGGTGATGCCTGCGGCGGTGGTGGTGGCGCGCGCGTAGTCGCGGACCCGGTTCCAGATGTTTCGCAGGGGCG

AGAAGTGTTCCATGGTCGGCACGCTCTGGCCGGTGAGGCGCGCGCAGTCGTTGACGCTCTATACACACACAAAAACGAAAGCGTTTACAGGGCTTTCGTTC

TGTAGCCTGGAGGAAAGTAAATGGGTTGGGTTGCGGTGTGCCCCGGTTCGAGACCAAGCTGAGCTCAGCCGGCTGAAGCCGCAGCTAACGTGGTATTGGCA

GTCCCGTCTCGACCCAGGCCCTGTATCCTCCAGGATACGGTCGAGAGCCCTTTTGCTTTCTTGGCCAAGCGCCCGTGGCGCGATCTGGGATAGATGGTCGC

GATGAGAGGACAAAAGCGGCTCGCTTCCGTAGTCTGGAGAAACAATCGCCAGGGTTGCGTTGCGGCGTACCCCGGTTCGAGCCCCTATGGCGGCTTGGATC

GGCCGGAACCGCGGCTAACGTGGGCTGTGGCAGCCCCGTCCTCAGGACCCCGCCAGCCGACTTCTCCAGTTACGGGAGCGAGCCCCTTTTGTTTTTTTATT

TTTTAGATGCATCCCGTGCTGCGGCAGATGCGCCCCTCGCCCCGGCCCGATCAGCAGCAGCAACAGCAGGCATGCAGACCCCCCTCTCCTCTCCCCGCCCC

GGTCACCACGGCCGCGGCGGCCGTGTCCGGTGCGGGGGGCGCGCTGGAGTCAGATGAGCCACCGCGGCGGCGACCTAGGCAGTATCTGGACTTGGAAGAGG

GCGAGGGACTGGCGCGGCTGGGGGCGAGCTCTCCAGAGCGCCACCCGCGGGTGCAGTTGAAAAGGGACGCGCGTGAGGCGTACCTGCCGCGGCAAAACCTG

TTTCGCGACCGCGGGGGCGAGGAGCCCGAGGAGATGCGGGACTGCAGGTTCCAAGCGGGGCGCGAGCTGCGCCCGCGGCTTGGACAGACAGCGCCTGCTGCG

CGAGGAGGACTTTGAGCCCGACACGCAGACGGGCATCAGCCCCGCGCGCGCGCACGTGGCCGCGGCCGACCTGGTGACCGCCTACGAGCAGACGGTGAACC

AGGAGCGCAACTTCCAAAAAAGCTTCAACAACCACGTGCGCACGCTGGTGGCGCGCGAGGAGGTGACCCTGGGTCTCATGCATCTGTGGGACCTGGTGGAG

GCGATCGTGCAGAACCCCAGCAGCAAGCCCCTGACCGCGCAGCTGTTCCTGGTGGTGCAGCACAGCAGGGACAACGAGGCCTTCAGGGAGGCGCTGCTGAA

CATCACCGAGCCGGAGGGGCGCTGGCTCCTGGACCTGATAAACATCCTGCAGAGCATAGTGGTGCAGGAGCGCAGCCTGAGCCTGGCCGAGAAGGTGGCGG

CCATTAACTATTCTATGCTGAGCCTGGGCAAGTTCTACGCTCGCAAGATCTACAAGACCCCCTACGTGCCCATAGACAAGGAGGTGAAGATAGACAGCTTC

TACATGCGCATGGCGCTGAAGGTGCTAACCCTGAGCGACGACCTGGGAGTGTACCGCAACGAGCGCATCCACAAGGCCGTGAGCGCCAGCCGGCGGCGCGA

GCTGAGCGACCGCGAACTGATGCACAGTCTGCAGCGCGCGCTGACCGGCGCGGGCGAGGGCGACAGGGAGGTCGAGTCCTACTTTGACATGGGGGCCGACC

TGCACTGGCAGCCGAGCCGCCGCGCCCTGGAAGCGGCGGGGGCGTACGGCGGCCCCCTGGCGGCCGATGACGAGGAAGAGGAGGACTATGAGCTAGAGGAG

GGCGAGTACCTGGAGGACTGACCTGGCTGGTGGTGTTTTGGTATAGATGCAAGATCCGAACGTGGCGGACCCGGCGGTCCGGGCGGCGCTGCAGAGCCAGC

-continued

CGTCCGGCATTAACTCCTCTGACGACTGGGCCGCGGCCATGGGTCGCATCATGGCCCTGACCGCGCGCAACCCCGAGGCCTTCAGGCAGCAGCCTCAGGCT

AACCGGCTGGCGGCCATCTTGGAAGCGGTAGTGCCCGCGCGCTCCAACCCCACCCACGAGAAGGTGCTGGCCATAGTCAACGCGCTGGCGGAGAGCAGGGC

CATCCGGGCAGACGAGGCCGGACTGGTGTACGATGCGCTGCTGCAGCGGGTGGCGCGGTACAACAGCGGCAACGTGCAGACCAACCTGGACCGCCTGGTGA

CGGACGTGCGCGAGGCCGTGGCGCAGCGCGAGCGCTTGCATCAGGACGGCAACCTGGGCTCGCTGGTGGCGCTAAACGCCTTCCTTAGCACCCAGCCGGCC

AACGTACCGCGGGGGCAGGAGGACTACACCAACTTCTTGAGCGCGCTGCGGCTGATGGTGACCGAGGTCCCTCAGAGCGAGGTGTACCAGTCGGGGCCCGA

CTACTTCTTCCAGACCAGCAGACAGGGCTTGCAAACCGTGAACCTGAGCCAGGCTTTCAAGAACCTGCGGGGGCTGTGGGGAGTGAAGGCGCCCACCGGCG

ACCGGGCTACGGTGTCCAGCCTGCTAACCCCCAACTCGCGCCTGCTGCTGCTGCTGATCGCGCCCTTCACGGACAGCGGGAGCGTCTCGCGGGAGACCTAT

CTGGGCCACCTGCTGACGCTGTACCGCGAGGCCATCGGGCAGGCGCAGGTGGACGAGCACACCTTCCAGGAGATCACCAGCGTGAGCCACGCGCTGGGGCA

GGAGGACACGGGCAGCCTGCAGGCGACCCTGAACTACCTGCTGACCAACAGGCGGCAGAAGATTCCCACGCTGCACAGCCTGACCCAGGAGGAGGAGCGCA

TCTTGCGCTACGTGCAGCAGAGCGTGAGCCTGAACCTGATGCGCGACGGCGTGACGCCCAGCGTGGCGCTGGACATGACCGCGCGCAACATGGAACCGGGC

ATGTACGCTTCCCAGCGGCCGTTCATCAACCGCCTGATGGACTACTTGCATCGGGCGGCGGCCGTGAACCCCGAGTACTTCACCAATGCCATTCTGAATCC

CCACTGGATGCCCCCTCCGGGTTTCTACAACGGGGACTTCGAGGTGCCTGAGGTCAACGATGGGTTCCTCTGGGATGACATGGATGACAGTGTGTTCTCCC

CCAACCCGCTGCGCGCCGCGTCTCTGCGATTGAAGGAGGGCTCTGACAGGGAAGGACCAAGGAGTCTGGCCTCCTCCCTGGCTCTGGGGGCGGTGGGCGCC

ACGGGCGCGGCGGCGCGGGGCAGCAGCCCCTTCCCCAGCCTGGCGGACTCTCTGAATAGCGGGCGGGTGAGCAGGCCCCGCTTGCTAGGCGAGGAGGAGTA

TCTGAACAACTCCCTGCTGCAGCCCGTGAGGGACAAAAACGCTCAGCGGCAGCAGTTTCCCAACAATGGGATAGAGAGCCTGGTGGACAAGATGTCCAGAT

GGAAGACGTATGCGCAGGAGTACAAGGAGTGGGAGGACCGCCAGCCGCGGCCCCTGCCGCCCCCTAGACAGCGCTGGCAGCGGCGCGCGTCCAACCGCCGC

TGGAGGCAGGGGCCCGAGGACGATGATGACTCTGCAGATGACAGCAGCGTGTTGGACCTGGGCGGGAGCGGGAACCCCTTTTCGCACCTGCGCCCACGCCT

GGGCAAGATGTTTTAAAAGAGAAAAATAAAAACTCACCAAGGCCATGGCGACGAGCGTTGGTTTTTTGTTCCCTTCCTTAGTATGCGGCGCGCGGCGATGT

TCGAGGAGGGGCCTCCCCCCTCTTACGAGAGCGCGATGGGAATTTCTCCTGCGGCGCCCCTGCAGCCTCCCTACGTGCCTCCTCGGTACCTGCAACCTACA

GGGGGGAGAAATAGCATCTGTTACTCTGAGCTGCAGCCCCTGTACGATACCACCAGACTGTACCTGGTGGACAACAAGTCCGCGGACGTGGCCTCCCTGAA

CTACCAGAACGACCACAGCGATTTTTTGACCACGGTGATCCAAAACAACGACTTCACCCCAACCGAGGCCAGTACCCAGACCATAAACCTGGACAACAGGT

CGAACTGGGGCGGCGACCTGAAGACTATCCTGCACACCAATATGCCCAACGTGAACGAGTTCATGTTCACCAACTCTTTTAAGGCGCGGGTGATGGTGGCG

CGCGAGCAGGGGGAGGCGAAGTACGAGTGGGTGGACTTCACGCTGCCCGAGGGCAACTACTCAGAGACCATGACTCTCGACCTGATGAACAATGCGATCGT

GGAACACTATCTGAAAGTGGGCAGGCAGAACGGGGTGAAGGAGAGCGATATCGGGGTCAAGTTTGACACCAGAAACTTCCGTCTGGGCTGGGACCCTGTGA

CCGGGCTGGTCATGCCGGGGGTCTACACCAACGAGGCCTTTCATCCCGATATAGTGCTCCTGCCCGGCTGTGGGGTGGACTTCACCCAGAGCCGGCTGAGC

AACCTGCTGGGCGTTCGCAAGCGGCAACCTTTCCAGGAGGGTTTCAAGATCACCTATGAGGATCTGGAGGGGGGCAACATTCCCGCGCTCCTTGATCTGGA

CGCCTACGAGGAGAGCTTGAAACCCGAGGAGAGCGCTGGCGACAGCGGCGAGAGTGGCGAGGAGCAAGCCGGCGGCGGCGGCAGCGCGTCGGTAGAAAACG

AAAGTACTCCCGCAGTGGCGGCGGACGCTGCGGAGGTCGAGCCGGAGGCCATGCAGCAGGACGCAGAGGAGGGCGCGCAGGAGGACATGAACAATGGGGAG

ATCAGGGGCGACACTTTCGCCACCCGGGGCGAAGAAAAAGAGGCAGAGGCGGCGGCGGCGACGGCGGAAGCCGAAACCGAGGCAGAGGCAGAGCCCGAGAC

CGAAGTTATGGAAGACATGAATGATGGAGAACGTAGGGGTGACACGTTTGCCACCCGGGGCGAAGAGAAGGCGGCGGAGGCAGAAGCCGCGGCTGAGGAGG

CGGCTGCGGCTGCGGCCAAGGCTGAGGCTGCGGCTGAGGCTAAGGTCGAAGCCGATGTTGCGGTTGAGGCTCAGGCTGAGGAGGAGGCGGCGGCTGAAGCA

GTTAAGGAAAAGGCCCAGGCAGAGCAGGAAGAGAAAAAACCTGTCATTCAACCTCTAAAAGAAGATAGCAAAAAGCGCAGTTACAACGTCATTGAGGGCAG

CACCTTTACCCAATACCGCAGCTGGTACCTGGCTTACAACTACGGCGACCCGGTCAAGGGGGTGCGCTCGTGGACCCTGCTCTGCACGCCGGACGTCACCT

GCGGCTCCGAGCAGATGTACTGGTCGCTGCCAAACATGATGCAAGACCCGGTGACCTTCCGTTCCACGCGGCAGGTTAGCAACTTTCCGGTGGTGGGCGCC

GAACTGCTGCCAGTACACTCCAAGAGTTTTTACAACGAGCAGGCCGTCTACTCCCAGCTGATCCGCCAGGCCACCTCTCTGACCCACGTGTTCAATCGCTT

TCCCGAGAACCAGATTTTGGCGCGCCCGCCGGCCCCCACCATCACCACCGTCAGTGAAAACGTTCCTGCCCTCACAGATCACGGGACGCTACCGCTGCGCA

ACAGCATCTCAGGAGTCCAGCGAGTGACCATTACTGACGCCAGACGCCGGACCTGCCCCTACGTTTACAAGGCCTTGGGCATAGTCTCGCCGCGCGTCCTC

TCCAGTCGCACTTTTTAAAACACATCCACCCACACGCTCCAAAATCATGTCCGTACTCATCTCGCCCAGCAACAACACCGGCTGGGGGCTGCGCGCACCCA

GCAAGATGTTTGGAGGGGCAAGGAAGCGCTCCGACCAGCACCCCGTGCGCGTGCGCGGCCACTACCGCGCGCCCTGGGGTGCGCACAAGCGCGGGCGCACA

GGGCGCACCACTGTGGATGATGTCATTGACTCCGTAGTGGAGCAGGCGCGCCACTACACACCCGGCGCGCCGACCGCCTCCGCCGTGTCCACCGTGGACCA

GGCGATCGAAAGCGTGGTACAGGGGGCGCGGCACTATGCCAACCTTAAAAGTCGCCGCCGCCGCGTGGCGCGCCGCCATCGCCGGAGACCCCGGGCTACTG

-continued

CCGCCGCGCGCCTTACCAAGGCTCTGCTCAAGCGCGCCAGGCGAACTGGCCACCGGGCCGCCATGAGGGCCGCACGGCGGGCTGCCGCTGCCGCGAGCGCC

GTGGCCCCGCGGGCACGAAGGCGCGCGGCCGCTGCCGCCGCCGCCGCCATTTCCAGCTTGGCCTCGACGCGGCGCGGTAACATATACTGGGTGCGCGACTC

GGTGAGCGGCACACGTGTGCCCGTGCGCTTTCGCCCCCCACGGAATTAGCACAAGACAACATACACACTGAGTCTCCTGCTGTTGTGTATCCCAGCGGCGA

CCGTCAGCAGCGGCGACATGTCCAAGCGCAAAATTAAAGAAGAGATGCTCCAGGTCATCGCGCCGGAGATCTATGGGCCCCCGAAGAAGGAGGAGGAGGAT

TACAAGCCCCGCAAGCTAAAGCGGGTCAAAAAGAAAAAGAAAGATGATGACGTTGACGAGGCGGTGGAGTTTGTCCGCCGCATGGCGCCCAGGCGCCCTGT

GCAGTGGAAGGGTCGGCGCGTGCAGCGAGTCCTGCGCCCCGGCACCGCGGTGGTCTTTACGCCCGGCGAGCGTTCCACGCGCACTTTCAAGCGGGTGTACG

ATGAGGTGTACGGCGACGAGGATCTGTTGGAGCAGGCCAACCATCGATTTGGGGAGTTTGCATATGGGAAACGGCCTCGCGAGAGTCTAAAAGAGGACCTG

CTGGCGCTACCGCTGGACGAGGGCAATCCCACCCCGAGTCTGAAGCCGGTGACCCTGCAACAGGTGCTGCCTTTGAGCGCGCCCAGCGAGCAGAAGCGAGG

GTTAAAGCGCGAGGGCGGGGACCTGGCACCCACCGTGCAGTTGATGGTGCCCAAGCGGCAGAAGCTGGAGGACGTGCTGGAGAAAATGAAAGTAGAGCCCG

GGATCCAGCCCGAGATCAAGGTCCGCCCTATCAAGCAGGTGGCGCCCGGCGTGGGAGTCCAGACCGTGGACGTTAGGATTCCCACGGAGGAGATGGAAACC

CAAACCGCCACTCCCTCTTCGGCAGCAAGCGCCACCACCGGCGCCGCTTCGGTAGAGGTGCAGACGGACCCCTGGCTACCCGCCGCCACTATCGCCGTCGC

CGCCGCCCCCCGTTCGCGCGGACGCAAGAGAAATTATCCAGCGGCCAGCGCGCTTATGCCCCAGTATGCGCTGCATCCATCCATCGCGCCCACCCCCGGCT

ACCGCGGGTACTCGTACCGCCCGCGCAGATCAGCCGGCACTCGCGGCCGCCGCCGCCGTGCGACCACAACCAGCCGCCGCCGTCGCCGCCGCCGCCAGCCA

GTGCTGACCCCCGTGTCTGTAAGGAAGGTGGCTCGCTCGGGGAGCACGCTGGTGGTGCCCAGAGCGCGCTACCACCCCAGCATCGTTTAAAGCCGGTCTCT

GTATGGTTCTTGCAGATATGGCCCTCACTTGTCGCCTTCGCTTCCCGGTGCCGGGATACCGAGGAAGAACTCACCGCCGCAGGGGCATGGCGGGCAGCGGT

CTCCGCGGCGGCCGTCGCCATCGCCGGCGCGCAAAGAGCAGGCGCATGCGCGGCGGTGTGTTGCCCCTGCTGGTCCCGCTACTCGCCGCGGCGATCGGCGC

CGTGCCCGGGATCGCCTCCGTGGCCCTGCAGGCGTCCCAGAAACATTGACTCTTGCAACCTTGCAAGCTTGCATTTTTGGAGGAAAAAATAAAAAAGTCTA

GACTCTCACGCTCGCTTGGTCCTGTGACTATTTTGTAGAAAAAAGATGGAAGACATCAACTTTGCGTCGCTGGCCCCGCGTCACGGCTCGCGCCCGTTCAT

GGGAGACTGGACAGATATCGGCACCAGCAATATGAGCGGTGGCGCCTTCAGCTGGGGCAGTCTGTGGAGCGGCCTTAAAAATTTTGGTTCCACCATTAAGA

ACTATGGCAACAAAGCGTGGAACAGCAGCACGGGTCAGATGCTGAGAGACAAGTTGAAAGAGCAGAACTTCCAGGAGAAGGTGGCGCAGGGCCTGGCCTCT

GGCATCAGCGGGGTGGTGGACATAGCTAACCAGGCCGTGCAGAAAAAGATAAACAGTCATCTGGACCCCCGCCCTCAGGTGGAGGAAACGCCTCCAGCCAT

GGAGACGGTGTCTCCCGAGGGCAAAGGCGAAAAGCGCCCGCGGCCCGACAGGGAAGAGACCCTGGTGTCACACACCGAGGAGCCGCCCTCTTACGAGGAGG

CAGTCAAGGCCGGCCTGCCCACCACTCGCCCCATAGCTCCCATGGCCACCGGTGTGGTGGGTCACAGGCAACACACCCCCGCAACACTAGATCTGCCCCCG

CCGTCCGAGCCGACTCGCCAGCCAAAGGCGGTGACGGTGTCCGCTCCCTCCACTTCCGCCGCCAACAGAGTGCCTCTGCGCCGCGCTGCGAGCGGCCCCCG

GGCCTCGCGAGTCAGCGGCAACTGGCAGAGCACACTGAACAGCATCGTGGGCCTGGGAGTGAGGAGTGTGAAGCGCCGCCGTTGCTACTGAATGAGCAAGC

TAGCTAACGTGTTGTATGTGTGTATGCGTCCTATGTCGCCGCCAGAGGAGCTGTTGAGCCGCCGGCGCCGTCTGCACTCCAGCGAATTTCAAGATGGCGAC

CCCATCGATGATGCCTCAGTGGTCGTACATGCACATCTCGGGCCAGGACGCTTCGGAGTACCTGAGCCCCGGGCTGGTGCAGTTCGCCCGCGCCACAGACA

CCTACTTCAACATGAGTAACAAGTTCAGGAACCCCACTGTGGCGCCCACCCACGATGTGACCACGGACCGGTCGCAGCGCCTGACGCTGCGGTTCATCCCC

GTGGATCGGGAGGACACCGCTTACTCTTACAAGGCGCGGTTCACGCTGGCCGTGGGCGACAACCGCGTGCTGGACATGGCCTCCACTTACTTTGACATCCG

GGGGGTGCTGGACAGGGGCCCCACTTTTAAGCCCTACTCGGGCACTGCCTACAACCCCCTGGCCCCCAAGGGCGCCCCCAATTCTTGTGAGTGGGAACAAG

AGGAAAATCAGGTGGTCGCTGCAGATGATGAACTTGAAGATGAAGAAGCGCAAGCACAAGAGGAAGCCCCTGTGAAAAAAATTCATGTATATGCTCAGGCG

CCTCTTTCTGGCGAAAAGATTTCCAAGGATGGTATCCAAATAGGTACTGAAGTCGTAGGAGATACATCTAAGGACACTTTTGCAGATAAAACATTCCAACC

CGAACCTCAGATAGGCGAGTCTCAGTGGAACGAGGCTGATGCCACAGCAGCAGGAGGTAGAGTTTTGAAAAAGACTACCCCTATGAGACCTTGCTATGGAT

CCTATGCCAGGCCTACCAATGCCAACGGGGGTCAAGGAATTATGGTTGCCAATGAACAAGGAGTGTTGGAGTCTAAAGTAGAAATGCAATTTTTCTCTAAC

ACCACAACCCTTAATGCGCGGGATGGAACCGGCAATCCCGAACCAAAGGTGGTGTTGTACAGCGAAGATGTCCACTTGGAATCTCCCGATACTCATCTGTC

TTACAAGCCCAAAAAGGATGATGTTAATGCCAAAATCATGTTGGGTCAGCAAGCCATGCCCAACAGACCCAACCTCATTGGATTTAGAGATAATTTCATTG

GGCTTATGTTTTACAACAGCACCGGTAACATGGGAGTGCTGGCGGGTCAGGCCTCTCAGTTGAATGCTGTGGTGGACTTGCAGGATAGAAACACAGAACTG

TCATATCAGCTTCTGCTTGATTCAATTGGGGATAGAACCAGATACTTCTCCATGTGGAACCAGGCAGTGGATAGCTATGATCCAGATGTCAGAATTATTGA

AAACCATGGGACTGAGGATGAACTGCCCAACTACTGCTTCCCTTTGGGCGGCATAGGAGTTACTGATACTTATCAAGGGATAAAAAATACCAATGGCAATG

GTCAGTGGACCAAAGATGATCAGTTCGCGGACCGCAACGAAATAGGGGTGGGAAACAACTTCGCCATGGAGATCAACATCCAGGCCAACCTTTGGAGAAAC

-continued

TTCCTCTATGCAAACGTGGGGCTCTACCTGCCAGACAAGCTCAAGTACAACCCCACCAACGTGGACATCTCTGACAACCCCAACACCTATGACTACATGAA

CAAGCGGGTGGTGGCCCCTGGCCTGGTGGACTGCTTTGTCAATGTGGGAGCCAGGTGGTCCCTGGACTACATGGACAACGTCAACCCCTTCAACCACCACC

GCAATGCGGGTCTGCGCTACCGCTCCATGATCCTGGGCAACGGGCGCTATGTGCCCTTTCACATCCAGGTACCCCAGAAGTTCTTTGCCATCAAGAACCTC

CTGCTCCTGCCCGGCTCCTACACCTACGAGTGGAACTTCAGGAAGGATGTGAACATGGTCCTACAGAGCTCTCTGGGCAATGACCTTAGGGTGGATGGGGC

CAGCATCAAGTTTGACAGCATCACCCTCTATGCTACATTTTTCCCCATGGCCCACAACACCGCCTCCACGCTTGAGGCCATGCTGAGAAACGACACCAACG

ACCAGTCCTTTAATGACTACCTCTCTGGGGCCAACATGCTCTACCCAATCCCAGCCAAGGCCACCAACGTGCCCATCTCCATCCCCTCTCGCAACTGGGCC

GCCTTTAGAGGCTGGGCCTTTACCCGCCTTAAGACCAAGGAGACCCCCTCCCTGGGCTCGGGTTTTGATCCCTACTTTGTTTACTCGGGATCCATCCCCTA

CCTGGATGGCACCTTCTACCTCAACCACACTTTCAAGAAGATATCCATCATGTATGACTCCTCCGTCAGCTGGCCGGGCAACGACCGCTTGCTCACCCCCA

ATGAGTTCGAGGTCAAGCGCGCCGTGGACGGCGAGGGCTACAACGTGGCCCAGTGCAACATGACCAAGGACTGGTTCCTGGTGCAGATGCTGGCCAACTAC

AACATAGGCTACCAGGGCTTTTACATCCCAGAGAGCTACAAGGACAGGATGTACTCCTTCTTCAGAAATTTCCAACCCATGAGCCGACAGGTGGTGGACGA

GACCAATTACAAGGACTATCAAGCCATTGGCATCACCCACCAGCACAACAACTCGGGTTTCGTGGGCTACCTGGCGCCCACCATGCGCGAGGGTCAGGCCT

ACCCCGCCAACTTCCCCTACCCCTTGATAGGCAAGACCGCGGTCGACAGCGTCACCCAGAAAAAGTTCCTCTGCGACCGCACCCTCTGGCGCATCCCCTTC

TCTAGCAACTTCATGTCCATGGGTGCGCTCACGGACCTGGGCCAAAACCTGCTTTATGCCAACTCTGCCCATGCGCTGGACATGACTTTTGAGGTGGACCC

CATGGACGAGCCCACCCTTCTCTATATTGTGTTTGAAGTGTTCGACGTGGTCAGAGTGCACCAGCCGCACCGCGGTGTCATCGAGACCGTGTACCTGCGTA

CGCCCTTCTCAGCCGGCAACGCCACCACCTAAGGAGACAGCGCCGCCGCCGCCTGCATGACGGGTTCCACCGAGCAAGAGCTCAGGGCCATTGCCAGAGAC

CTGGGATGCGGACCCTATTTTTTGGGCACCTATGACAAACGCTTCCCGGGCTTTATCTCCCGAGACAAGCTCGCCTGCGCCATTGTCAACACGGCCGCGCG

CGAGACCGGGGGCGTGCACTGGCTGGCCTTTGGCTGGGACCCGCGCTCCAAAACTTGCTACCTCTTTGACCCCTTTGGCTTCTCCGATCAGCGCCTCAGGC

AGATTTATGAGTTTGAGTACGAGGGGCTGCTGCGCCGCAGCGCGCTCGCCTCCTCGCCCGACCGCTGCATCACCCTTGAGAAGTCCACCGAAACCGTGCAG

GGGCCCCACTCGGCCGCCTGCGGTCTCTTCTGTTGCATGTTTTTGCACGCCTTTGTGCACTGGCCTCAGAGTCCCATGGATTGCAACCCCACCATGAACTT

GCTAAAGGGAGTGCCCAACGCCATGCTCCAGAGCCCCCAGGTCCAGCCCACCCTGCGCCGCAACCAGGAACAGCTTTACCGCTTCCTGGAGCGCCACTCCC

CCTACTTCCGCAGCCACAGCGCGCGCATCCGGGGGGCCACCTCTTTTTGCCACTTGCAAGAAAACATGCAAGACGGAAAATGATGTACAGCATGCTTTTAA

TAAATGTAAAGACTGTGCACTTTAATTATACACGGGCTCTTTCTGGTTATTTATTCAACACCGCCGTCGCCATTTAGAAATCGAAAGGGTTCTGCCGTGCG

TCGCCGTGCGCCACGGGCAGAGACACGTTGCGATACTGGAAGCGGCTCGCCCACTTGAACTCGGGCACCACCATGCGGGGCAGTGGTTCCTCGGGGAAGTT

CTCGCTCCACAGGGTGCGGGTCAGCTGCAGCGCGCTCAGGAGGTCGGGAGCCGAGATCTTGAAGTCGCAGTTGGGGCCGGAACCCTGCGCGCGCGAGTTGC

GGTACACGGGGTTGCAGCACTGGAACACCAGCAGGGCCGGATTATTCACGCTGGCCAGCAGGCTCTCGTCGCTGATCATGTCGCTGTCCAGATCCTCCGCG

TTGCTCAGGGCGAATGGGGTCATCTTGCAGACCTGCCTGCCCAGGAAAGGCGGGAGCCCAGGCTTGCCGTTGCAGTCGCAGCGCAGGGGCATTAGCAGGTG

CCCACGGCCCGACTGCGCCTGCGGGTACAACGCGCGCATGAAGGCTTCGATCTGCCTAAAAGCCACCTGGGTCTTGGCTCCCTCCGAAAAGAACATCCCAC

AGGACTTGCTGGAGAACTGGTTCGCGGGACAGCTGGCATCGTGCAGGCAGCAGCGCGCGTCAGTGTTGGCAATCTGCACCACGTTGCGACCCCACCGGTTT

TTCACTATCTTGGCCTTGGAAGCCTGCTCCTTTAGCGCGCGCTGGCCGTTCTCGCTGGTCACATCCATCTCTATCACCTGTTCCTTGTTGATCATGTTTGT

CCCGTGCAGACACTTTAGGTCGCCCTCCGTCTGGGTGCAGCGGTGCTCCCACAGCGCGCAACCGGTGGGCTCCCAATTCTTGTGGGTCACCCCCGCGTAGG

CCTGCAGGTAGGCCTGCAGGAAGCGCCCCATCATGGTCATAAAGGTCTTCTGGCTCGTAAAGGTCAGCTGCAGGCCGCGATGCTCTTCGTTCAGCCAGGTC

TTGCAGATGGCGGCCAGCGCCTCGGTCTGCTCGGGCAGCATCTTAAAATTTGTCTTCAGGTCGTTATCCACGTGGTACTTGTCCATCATGGCACGCGCCGC

CTCCATGCCCTTCTCCCAGGCGGACACCATGGGCAGGCTTAGGGGGTTTATCACTTCCAGCGGCGAGGACACCGTACTTTCGATTTCTTCTTCCTCCCCCT

CTTCCCGGCGCGCGCCCCCGCTGTTGCGCGCTCTTACCGCCTGCACCAAGGGGTCGTCTTCAGGCAAGCGCCGCACCGAGCGCTTGCCGCCCTTGACCTGC

TTGATCAGTACCGGCGGGTTGCTGAAGCCCACCATGGTCAGCGCCGCCTGCTCTTCTTCGTCTTCGCTGTCTACCACTATTTCTGGGGAGGGGCTTCTCCG

CTCTGCGGCAAAGGCGGCGGATCGCTTCTTTTTTTTTCTTGGGAGCCGCCGCGATGGAGTCCGCCACGGCGACCGAGGTCGAGGGCGTGGGGCTGGGGGTGC

GCGGTACCAGGGCCTCGTCGCCCTCGGACTCTTCCTCTGACTCCAGGCGGCGGCGGAGTCGCTTCTTTGGGGGCGCGCGCGTCAGCGGCGGCGGAGACGGG

GACGGGGACGGGGACGGGACGCCCTCCACAGGGGGTGGTCTTCGCGCAGACCCGCGGCCGCGCTCGGGGGTCTTCTCGCGCTGGTCTTGGTCCCGACTGGC

CATTGTATCCTCCTCCTCCTAGGCAGAGAGACATAAGGAGTCTATCATGCAAGTCGAGAAGGAGGAGAGCTTAACCACCCCCTCAGAGACCGCCGATGCGC

CCGCCGTCGCCGTCGCCCCCGCTACCGCCGACGCGCCCGCCACACCGAGCGACACCCCCACGGACCCCCCCGCCGACGCACCCCTGTTCGAGGAAGCGGCC

GTGGAGCAGGACCCGGGCTTTGTCTCGGCAGAGGAGGATTTGCAAGAGGAGGAGAATAAGGAGGAGAAGCCCTCAGTGCCAAAAGATCATAAAGAGCAAGA

-continued

CGAGCACGACGCAGACGCACACCAGGGTGAAGTCGGGCGGGGGGACGGAGGGCATGGCGGCGCCGACTACCTAGACGAAGGAAACGACGTGCTCTTGAAGC
ACCTGCATCGTCAGTGCGCCATCGTCTGCGACGCTCTGCAGGAGCGCAGCGAGGTGCCCCTCAGCGTGGCGGAGGTCAGCCGCGCCTACGAGCTCAGCCTC
TTTTCCCCCCGGGTGCCCCCCCGCCGCCGCGAAAACGGCACATGCGAGCCCAACCCGCGCCTCAACTTCTACCCCGCCTTTGTGGTGCCCGAGGTCCTGGC
CACCTATCACATCTTCTTTCAAAATTGCAAGATCCCCATCTCGTGCCGCGCCAACCGTAGCCGCGCCGATAAGATGCTGGCCCTGCGCCAGGGCGACCACA
TACCTGATATCGCCGCTTTGGAAGATGTGCCAAAGATCTTCGAGGGTCTGGGGCGCAACGAGAAGCGGGCAGCAAACTCTCTGCAACAGGAAAACAGCGAA
AATGAGAGTCACACTGGAGCGCTGGTGGAGCTGGAGGGCGACAACGCCCGCCTGGCGGTGCTCAAGCGCAGCATCGAGGTCACCCACTTTGCCTACCCCGC
GCTCAACCTGCCCCCCAAAGTCATGAACGCGGTCATGGACGGGCTGATCATGCGCCGCGGCCGGCCCCTCGCTCCAGATGCAAACTTGCATGAGGAGACCG
AGGACGGTCAGCCCGTGGTCAGCGACGAGCAGCTGACGCGCTGGCTGGAGAGCGCGGACCCCGCCGAACTGGAGGAGCGGCGCAAGATGATGATGGCCGCG
GTGCTGGTCACCGTAGAGCTGGAGTGTCTGCAGCGCTTCTTCGGTGACCCCGAGATGCAGAGAAAGGTCGAGGAGACCCTACACTACACCTTCCGCCAGGG
CTACGTGCGCCAGGCTTGCAAGATCTCCAACGTGGAGCTCAGCAACCTGGTGTCCTACCTGGGCATCTTGCATGAAAACCGCCTTGGGCAGAGCGTGCTAC
ACTCCACCCTGCGCGGGGAGGCGCGCCGCGACTACGTGCGCGACTGCGTTTACCTCTTCCTCTGCTACACCTGGCAGACGGCCATGGGGGTCTGGCAGCAG
TGCCTGGAGGAGCGCAACCTCAAGGAGCTGGAGAAGCTTCTGCAGCGCGCGCTCAAAGACCTCTGGACGGGCTTCAACGAGCGCTCGGTGGCCGCCGCGCT
AGCCGACCTCATCTTCCCCGAGCGCCTGCTCAAAACCCTCCAGCAGGGGCTGCCCGACTTCACCAGCCAAAGCATGTTGCAAAATTTTAGGAACTTTATCC
TGGAGCGTTCTGGCATCCTACCCGCCACCTGCTGCGCCCTGCCCAGCGACTTTGTCCCCCTCGTGTACCGCGAGTGCCCCCCGCCGCTGTGGGGCCACTGC
TACCTGTTCCAACTGGCCAACTACCTGTCCTACCACGCGGACCTCATGGAGGACTCCAGCGGCGAGGGGCTCATGGAGTGCCACTGCCGCTGCAACCTCTG
CACGCCCCACCGCTCCCTGGTCTGCAACACCCAACTGCTCAGCGAGAGTCAGATTATCGGTACCTTCGAGCTACAGGGTCCGTCCTCCTCAGACGAGAAGT
CCGCGGCTCCGGGGCTAAAACTCACTCCGGGGCTGTGGACTTCCGCCTACCTGCGCAAATTTGTACCTGAAGACTACCACGCCCACGAAATCAGGTTTTAC
GAGGACCAATCCCGCCCGCCCAAGGCGGAGCTGACCGCCTGCGTCATCACCCAGGGCGAGATCCTAGGCCAATTGCAAGCCATCCAAAAAGCCCGCCAAGA
GTTTTTGCTGAAGAGGGGTCGGGGGGTGTATCTGGACCCCCAGTCGGGTGAGGAGCTCAACCCGGTTCCCCCGCTGCCACCGCCGCGGGACCTTGCTTCCC
AGGATAAGCATCGCCATGGCTCCCAGAAAGAAGCAGCAGCGGCCGCCGCTGCCGCCGCCCCACATGCTGGAGGAAGAGGAGGAATACTGGGACAGTCAGGC
AGAGGAGGTTTCGGACGAGGAGGAGCCGGAGACGGAGATGGAAGAGTGGGAGGAGGACAGCTTAGACGAGGAGGCTTCCGAAGCCGAAGAGGCAGGCGCAA
CACCGTCACCCTCGGCCGCAGCCCCCTCGCAGGCGCCCCCGAAGTCCGCTCCCAGCATCAGCAGCAACAGCAGCGCTATAACCTCCGCTCCTCCACCGCCG
CGACCCACGGCCGACCGCAGACCCAACCGTAGATGGGACACCACCGGAACCGGGGCCGGTAAGTCCTCCGGGAGAGGCAAGCAAGCGCAGCGCCAAGGCTA
CCGCTCGTGGCGCGCTCACAAGAACGCCATAGTCGCTTGCTTGCAAGACTGCGGGGGGAACATCTCCTTCGCCCGCCGCTTCCTGCTCTTCCACCACGGTG
TGGCCTTCCCCCGTAACGTCCTGCATTACTACCGTCATCTCTACAGCCCCTACTGCGGCGGCAGTGAGCCAGAGGCGGCCAGCGGCGGCGGCGCCCGTTTC
GGTGCCTAGGAAGACCCAGGGCAAGACTTCAGCCAAGAAACTCGCGGCGACCGCGGCGAACGCGGTCGCGGGGGCCCTGCGCCTGACGGTGAACGAACCCC
TGTCGACCCGCGAACTGAGGAACCGAATCTTCCCCACTCTCTATGCCATCTTCCAGCAGAGCAGAGGGCAGGATCAGGAACTGAAAGTAAAAAACAGGTCT
CTGCGCTCCCTCACCCGCAGCTGTCTGTATCACAAGAGCGAAGACCAGCTTCGGCGCACGCTGGAGGACGCTGAGGCACTCTTCAGCAAATACTGCGCGCT
CACTCTTAAGGACTAGCTCCGCGCCCTTCTCGAATTTAGGCGGGAACGCCTACGTCATCGCAGCGCCGCCGTCATGAGCAAGGACATTCCCACGCCATACA
TGTGGAGCTATCAGCCGCAGATGGGACTCGCGGCGGGCGCCTCCCAAGACTACTCCACCCGCATGAACTGGCTCAGTGCCGGCCCACACATGATCTCACAG
GTTAATGACATCCGCACCCATCGAAACCAAATATTGGTGAAGCAGGCGGCAATTACCACCACGCCCCGCAATAATCCCAACCCCAGGGAGTGGCCCGCGTC
CCTGGTGTATCAGGAAATTCCCGGCCCCACCACCGTACTACTTCCGCGTGATTCCCAGGCCGAAGTCCAAATGACTAACTCAGGGGCACAGCTCGCGGGCG
GCTGTCGTCACAGGGTGCGGCCTCCTCGCCAGGGTATAACTCACCTGGAGATCCGAGGCAGAGGTATTCAGCTCAACGACGAGTCGGTGAGCTCCTCGCTC
GGTCTCAGACCTGACGGGACCTTCCAGATAGCCGGAGCCGGCCGATCTTCCTTCACGCCCCGCCAGGCGTACCTGACTCTGCAGAGCTCGTCCTCGGCGCC
GCGCTCGGGCGGCATCGGGACTCTCCAGTTCGTGCAGGAGTTTGTGCCCTCGGTCTACTTCAACCCCTTCTCGGGCTCTCCCGGTCGCTACCCGGACCAGT
TTATCCCGAACTTTGACGCCGCGAGGGACTCGGTGGACGGCTACGACTGAATGTCGGGTGGACCCGGTGCAGAGCAACTTCGCCTGAAGCACCTTGACCAC
TGCCGCCGCCCTCAGTGCTTTGCCCGCTGTCAGACCGGTGAGTTCCAGTACTTTTCCCTGCCCGACTCGCACCCGGACGGCCCGGCGCACGGGGTGCGCTT
TTTCATCCCGAGTCAGGTCCGCTCTACCCTAATCAGGGAGTTCACCGCCCGTCCCCTACTGGCGGAGTTGGAAAAGGGGCCTTCTATCCTAACCATTGCCT
GCATTTGCTCTAACCCTGGATTACACCAAGATCTTTGCTGTCATTTGTGTGCTGAGTATAATAAAGGCTGAGATCAGAATCTACTCGGGCTCCTGTCGCCA
TCCTGTCAACGCCACCGTCCAAGCCCGGCCCGATCAGCCCGAGGTGAACCTCACCTGTGGTCTGCACCGGCGCCTGAGGAAATACCTAGCTTGGTACTACA

-continued

ACAGCACTCCCTTTGTGGTTTACAACAGCTTTGACCAGGACGGGGTCTCACTGAGGGATAACCTCTCGAACCTGAGCTACTCCATCAGGAAGAACAACACC

CTCGAGCTACTTCCTCCTTACCTGCCCGGGACTTACCAGTGTGTCACCGGCCCCTGCACCCACACCCACCTGTTGATCGTAAACGACTCTCTTCCGAGAAC

AGACCTCAATAACTCCTCTCCGCAGTTCCCCAGAACAGGAGGTGAGCTCAGGAAACCCCGGGTAAAGAAGGGTGGACAAGAGTTAACACTTGTGGGGTTTC

TGGTATATGTGACGCTGGTGGTGGCTCTTTTGATTAAGGCTTTTCCTTCCATGTCTGAACTATCCCTCTTCTTTTATGAACAACTCGACTAGTGCTAACGG

GACCCTACCCAACGAATCGGGATTGAATATCGGTAACCAGGTTGCAGTTTCACTTTTGATTACCTTCATAGTCCTCTTCCTGCTAGTGCTGTCGCTTCTGT

GCCTGCGGATCGGGGGCTGCTGCATCCACGTTTATATCTGGTGCTGGCTGTTTAGAAGGTTCGGAGACCACCGCAGGTAGAATAATGCTGCTTACCCTCTT

TGTCCTGGCGCTGGCTGCCAGCTGCCAAGCCTTTTCCGAGGCTGACTTCATAGAGCCCCAGTGCAATATCACTTATAAATCTGAACGTGCCATCTGTACTA

TTCTAATCAAATGTGTTACTCAACACGATAAGGTGACTGTTAAATACAAAGATCAATTAAAAAAAGACGCACTTTACAGCAGCTGGCAACCAGGAGATGAT

CAAAAATACAATGTAACCGTCTTCCAGGGCAAACTCTCCAAAACTTACAATTACAATTTCCCATTTGAGCAGATGTGTGACTTTGTCATGTACATGGAAAA

GCAGTACAAGCTGTGGCCTCCAACTCCCCAGGGCTGTGTGGAAAATCCAGGCTCTTTCTGTATGATCTCTCTCTGTGTAACTGTGCTGGCACTAATACTCA

CGCTTCTGTATCTCAGATTTAAATCAAGGCAAAGCTTCATTGATGAAAAGAAAATGCCATAATCGCTCAACGCTTGATTGCTAACACCGGGTTTTTATCCG

CAGAATGATTGGAATCACCCTACTAATCACCTCCCTCCTTGCGATTGCCCATGGGTTGGAACGAATCGAAGTCCCTGTGGGGGCCAATGTTACCCTGGTGG

GGCCTGTCGGCAATGCTACATTAATGTGGGAAAAATATACTAAAAATCAATGGGTTTCTTACTGCACTAACAAAAACAGCCACAAGCCCAGAGCCATCTGC

GATGGGCAAAATCTAACCTTGATTGATGTTCAATTGCTGGATGCGGGCTACTATTATGGGCAGCTGGGTACAATGATTAATTACTGGAGACCCCACAGAGA

TTACATGCTTCACGTAGTAAAGGGTCCCATTAGCAGCCCAACCACCACCTCTACCACACCCACTACCACCACTACTCCCACCACCAGCACTGCCGCCCAGC

CTCCTCATAGCAGAACAACCACTTTTATCAATTCCAAGTCCCACTCCCCCCACATTGCCGGCGGGCCCTCCGCCTCAGACTCCGAGACCACCGAGATCTGC

TTCTGCAAATGCTCTGACGCCATTGCCCAGGATTTGGAAGATCACGAGGAAGATGAGCATGACTACGCAGATGCATGCCAGGCATCAGAGGCAGAAGCGCT

ACCGGTGGCCCTAAAACAGTATGCAGACTCCCACACCACCCCCAACCTTCCTCCACCTTCCCAGAAGCCAAGTTTCCTGGGGGAAAATGAAACTCTGCCTC

TTTCCATACTAGCTCTGACATCTGTTGCTATTTTGGCCGCTCTGCTGGTGCTTCTATGCTCTATATGCTACCTGATCTGCTGCAGAAAGAAAAAATCTCAC

GGCCATGCTCACCAGCCCCTCATGCACTTCCCTTACCCTCCAGAGCTGGGCGACCACAAACTTTAAGTCTGCAGTAGCTATCTGCCCATCCCTTGTCAGTC

GACAGCGATGAGCCCCACTAATCTAACAGCCTCTGGACTTACAACATTGTCTCTTAATGAGACCACCGCTCCTCAAGACCTGTACGATGGTGTCTCCGCGC

TGGTTAACCAGTGGGATCACCTGGGCATATGGTGGCTCCTCATAGGAGCAGTGACCCTGTGCCTAATCCTGGTCTGGATCATCTGCTGCATCAAAAGCAGA

AGACCCAGGCGGCGGCCCATCTACAGGCCCTTCGTCATCACACCTGAAGATAATGATGATGATGACACCACCTCCAGGCTGCAGAGCCTAAAGCAGCTACT

CTTCTCTTTTACAGCATGGTAAATTGAATCATGCCCCGCATTTTCATCTACTTGCTTCTCCTTCCACTTTTTCTGGGCTCCTCTACATTGGCCACTGTGTC

CCACATCGAGGTAGACTGCCTCACGCCCTTCACAGTCTACCTGCTTTTCGGCTTTGTCATCTGCACCTTTGTCTGCAGCGTTATCACTGTAGTGATCTGCT

TCATACAGTGCATCGACTACATCTGTGTGCGGGTGGCCTACTTTAGACACCACCCCCAGTATCGCAACAGGGACATAGCGGCTCTCCTAAGACTTGTTTAA

ATCATGGCCAAATTACCTGTGATTGGTCTTCTGATTATCTGCTGCGTCCTAGCCGCGATTGGGACTCAACCTAATACCACCACCAGCGCTCCCAGAAAGAG

ACATGTATCCTGCAGCTTCAAGCGTCCCTGGAATATACCCCAATGCTTTACTGATGAACCTGAAATCTCTTTGGCTTGGTACTTCAGCGTCACCGCCCTTC

TCATCTTCTGCAGTACGGTTATTGCTCTTGCCATCTACCCTTCCCTTAACCTGGGCTGGAATGCTGTCAACTCTATGGAATATCCCACCTTCCCAGAACCA

GACCTGCCAGACCTGGTTGTTCTAAACGCGTTTCCTCCTCCTCCAGTTCAAAATCAGTTTCGCCCTCCGTCCCCTACGCCCACTGAGGTCAGCTACTTTAA

TCTAACAGGCGGAGATGACTGAAAACCTAGACCTAGAAATGGACGGTCTCTGCAGCGAGCAACGCACACTAGAGAGGCGCCGGCAAAAAGCAGAGCTCGAG

CGTCTTAAACAAGAGCTCCAAGACGCCGTGGCCATACACCAGTGCAAAAAAGGGCTCTTCTGTCTGGTAAAACAGGCCACGCTCACCTATGAAAAAACAGG

TGACACCCACCGCCTAGGATACAAGCTGCCCACACAGCGCCAAAAGTTTGCCCTTATGATAGGTGAACAACCCATCACCGTCACCCAGCACTCCGTGGAGA

CAGAAGGCTGCATTCATGCTCCCTGCAGGGGCGCTGACTGCCTCTACACCTTGATCAAAACCCTCTGCGGTCTCAGAGACCTTATCCCTTTCAATTGATCA

TAACTGTAATCAATAAAAAATCACTTACTTGAAATCTGATAGCAAGACTCTGTCCAATTTTTTCAGCAACACTTCCTTCCCCTCCTCCCAACTCTGGTACT

CTAGGCGCCTCCTAGCTGCAAACTTCCTCCACAGTCTGAAGGGAATGTCAGATTCCTCCTCCTGTCCCTCCGCACCCACGATCTTCATGTTGTTACAGATG

AAACGCGCGAGATCGTCTGACGAGACCTTCAACCCCGTGTACCCCTACGATACCGAGATCGCTCCGACTTCTGTCCCTTTCCTTACCCCTCCCTTTGTATC

ATCCGCAGGAATGCAAGAAAATCCAGCTGGGGTGCTGTCCCTGCACCTGTCAGAGCCCCTTACCACCCACAATGGGGCCCTGACTCTAAAAATGGGGGGCG

GCCTGACCCTGGACAAGGAAGGGAATCTCACTTCCCAAAACATCACCAGTGTCGATCCCCCTCTCAAAAAAAGCAAGAACAACATCAGCCTTCAGACCGCC

GCACCCCTCGCCGTCAGCTCCGGGGCCCTAACCCTTTTTGCCACTCCCCCCCTAGCGGTCAGTGGCGACAACCTTACTGTGCAGTCTCAGGCCCCTCTTAC

TTTGGAAGACTCAAAACTAACTCTGGCCACCAAAGGACCCCTAACTGTGTCCGAAGGCAAACTTGTCCTAGAAACAGAGCCTCCCCTGCATGCAAGTGACA

-continued

GCAGTAGCCTGGGCCTTAGCGTCACGGCCCCACTTAGCATTAACAATGACAGCCTAGGACTAGACATGCAAGCGCCCATCAGCTCTCGAGATGGAAAACTG

GCTCTAACAGTGGCGGCCCCCCTAACTGTGGCCGAGGGTATCAATGCTTTGGCAGTAGCCACAGGTAATGGTATTGGACTAAATGAAACCAACACACACCT

GCAGGCAAAACTGGTCGCGCCCCTAGGCTTTGATACCAACGGCAACATTAAGCTAAGCGTCGCAGGAGGCATGAGGCTAAACAATAACACACTGATACTAG

ATGTAAACTACCCATTTGAGGCTCAAGGCCAACTGAGCCTAAGAGTGGGCTCGGGCCCACTATATGTAGATTCTAGTAGTCATAACCTAACCATTAGATGC

CTTAGGGGATTGTATGTAACATCTTCTAACAACCAAAACGGTCTAGAGGCCAACATTAAACTAACAAAAGGCCTTGTGTATGACGGAAATGCCATAGCAGT

TAATGTTGGCAAAGGGCTGGAATACAGCCCTACTGGCACAACAGAAAAACCTATACAGACTAAAATAGGTCTAGGCATGGAGTATGACACTGAGGGAGCCA

TGATGACAAAACTAGGCTCTGGACTAAGCTTTGACAATTCAGGAGCCATTGTGGTGGGAAACAAAAATGATGACAGGCTTACTTTGTGGACCACACCGGAC

CCATCGCCCAACTGTCAGATTTACTCTGAAAAAGATGCTAAACTAACCTTGGTACTGACTAAATGTGGCAGTCAGGTTGTAGGCACAGTATCTATTGCCGC

TCTTAAAGGTAGCCTTGTGCCAATCACTAGTGCAATCAGTGTGGTTCAGATATACCTAAGGTTTGATGAAAATGGGGTGCTGATGAGTAACTCTTCACTTA

ATGGCGAATACTGGAATTTTAGAAACGGAGACTCAACTAATGGCACACCATATACAAACGCAGTGGGTTTTATGCCTAATCTACTGGCCTATCCTAAAGGT

CAAACTACAACTGCAAAAAGTAACATTGTCAGCCAGGTCTACATGAACGGGGACGATACTAAACCCATGACATTTACAATCAACTTCAATGGCCTTAGTGA

AACAGGGGATACCCCTGTCAGTAAATATTCCATGACATTCTCATGGAGGTGGCCAAATGGAAGCTACATAGGGCACAATTTTGTAACAAACTCCTTTACTT

TCTCCTACATCGCCCAAGAATAAAGAAAGCACAGAGATGCTTGTTTTTGATTTCAAAATTGTGTGCTTTTATTTATTTTCAAGCTTACAGTATTTCCAGTA

GTCATTAGAATAGAGCTTAATTAAACTGCATGAGAACCCTTCCACATAGCTTAAATTATCACCAGTGCAAATGGAAAAAAATCAACATACCTTTTTATCCA

GATATCAAAGAACTCTAGTGGTCAGTTTTCCCCCACCCTCCCAGCTCACAGAATACACAGTCCTTTCCCCCCGGCTGGCTTTAAACAACACTATCTCATTG

GTAACAGACATATTTTTAGGTGTAATAATCCACACGGTCTCTTGGCGGGCCAAACGCTGGTCTGTGATGTTAATAAACTCCCCAGGCAGCTCTTTCAAGTT

CACGTCGCTGTCCAACTGCTGAAGCGCTCGCGGCTCCGACTGCGCCTCTAGCGGAGGCAACGGCAGCACCCGATCCTTGATCTATAAAGGAGTAGAGTCAT

AATCCCCCATAAGAATAGGGCGGTGATGCAGCAACAAGGCGCGCAGCAACTCCTGCCGCCGCCTCTCCGTACGACAGGAATGCAACGGGGTGGTGGTCTCC

TCCGCGATAATCCGCACCGCTCGCAGCATCAGCATCCTCGTCCTCCGGGCACAGCAGCGCATCCTGATCTCACTGAGATCGGCGCAGTAAGTGCAGCACAA

CACCAAGATGTTATTTAAGATCCCACAGTGCAAAGCACTGTACCCAAAGCTCATGGCGGGAAGGACAGCCCCCACGTGACCATCGTACCAGATCCTCAGGT

AAATCAAATGACGACCTCTCATAAACACGCTGGACATATACATCACCTCCTTGGGCATGAGCTGATTCACCACCTCTCGATACCACAGGCATCGCTGATTA

ATTAAAGACCCCTCGAGCACCATCCTGAACCAGGAAGCCAGCACCTGACCCCCCGCCAGGCACTGCAGGGACCCCGGTGAATCGCAGTGGCAGTGAAGACT

CCAGCGCTCGTAGCCGTGAACCATAGAGCTGGTCATTATATCCACATTGGCACAACACAGACACACTTTCATACACTTTTTCATGATTAGCAGCTCCTCTC

TAGTCAAGACCATATCCCAAGGAATCACCCACTCTTGAATCAAGGTAAATCCCACACAGCAGGGCAGGCCTCTCACATAACTCACGTTATGCATAGTGAGC

GTGTCGCAATCTGGAAATACCGGATGATCTTCCATCACCGAAGCCCGGGTCTCCGTCTCAAAGGGAGGTAAACGGTCCCTCGTGTAGGGACAGTGGCGGGA

TAATCGAGATCGTGTTGAACGTAGAGTCATGCCAAAGGGAACAGCGGACGTACTCATATTTCCTCCAGCAGAACCAAGTGCGCGCGTGGCAGCTATCCCTG

CGTCTTCTGTCTCGCCGCCTGCCCCGCTCGGTGTAGTAGTTGTAATACAGCCACTCCCTCAGACCGTCAAGGCGCTCCCTGGCGTCCGGATCTATAACAAC

ACCGTCCTGCAGCGCCGCCCTGATGACATCCACCACCGTAGAGTATGCCAAGCCCAGCCACGAAATGCACTCACTTTGACAGCGAGAGATAGGAGGAGCGG

GAAGAGATGGAAGAACCATGATAGTAAAAGAACTTTTATTCCAATCGATCCTCTACAATGTCAAAGTGTAGATCTATCAGATGGCACTGGTCTCCTCCGCT

GAGTCGATCAAAAATAACAGCTAAACCACAAACAACACGATTGGTCAAATGCTGCACAAGGGCTTGCAGCATAAAATCGCCTCGAAAGTCCACCGCAAGCA

TAACATCAAAGCCACCGCCCCTATCATGATCTATGATAAAAACCCCACAGCTATCCACCAGACCCATATAGTTTTCATCTCTCCATCGTGAAAAAATATTT

ACAAGCTCCTCCTTTAAATCACCTCCAACCAATTCAAAAAGTTGAGCCAGACCGCCCTCCACCTTCATTTTCAGCATGCGCATCATGATTGCAAAAATTCA

GGCTCCTCAGACACCTGTATAAGATTGAGAAGCGGAACGTTAACATCAATGTTTCGCTCGCGAAGATCGCGCCTCAGTGCAAGCATGATATAATCCCACAG

GTCGGAGCGGATCAGCGAGGACATCTCCCCGCCAGGAACCAACTCAACGGAGCCTATGCTGATTATAATACGCATATTCGGGGCTATGCTAACCAGCACGG

CCCCCAAATAGGCGTACTGCATAGGCGGCGACAAAAAGTGAACAGTTTGGGTTAAAAAATCAGGCAAACACTCGCGCAAAAAAGCAAGAACATCATAACCA

TGCTCATGCAAATAGATGCAAGTAAGCTCAGGAACGACCACAGAAAAATGCACAATTTTTCTCTCAAACATGACTGCGAGCCCTGCAAAAAATAAAAAAGA

AACATTACACAAGAGTAGCCTGTCTTACAATGGGATAGACTACTCTAACCAACATAAGACGGGCCACGACATCGCCCGCGTGGCCATAAAAAAAAATTATCC

GTGTGATTAAAAAGAAGCACAGATAGCTGGCCAGTCATATCCGGAGTCATCACGTGCGAACCCGTGTAGACCCCCGGGTTGGACACATCGGCCAAACAAAG

AAAGCGGCCAATGTATCCCGGAGGAATGATAACACTAAGACGAAGATACAACAGAATAACCCCATGGGGGGGAATAACAAAGTTAGTAGGTGAATAAAAAC

GATAAACACCCGAAACTCCCTCCTGCGTAGGCAAAATAGCGCCCTCCCCTTCCAAAACAACATACAGCGCTTCCACAGCAGCCATGACAAAAGACTCAAAA

-continued

```
CACTCAAAAGACTCAGTCTTACCAGGAAAATAAAAGCACTCTCACAGCACCAGCACTAATCAGAGTGTGAAGAGGGCCAAGTGCCGAACGAGTATATATAG

GAATTAAAAATGACGTAAATGTGTAAAGGTCAAAAAACGCCCAGAAAAATACACAGACCAACGCCCGAAACGAAAACCCGCGAAAAAATACCCAGAAGTTC

CTCAACAACCGCCACTTCCGCTTTCCCACGATACGTCACTTCCTCAAAAATAGCAAACTACATTTCCCACATGTACAAAACCAAAACCCCTCCCCTTGTCA

CCGCCCACAACTTACATAATCACAAACGTCAAAGCCTACGTCACCCGCCCCGCCTCGCCCCGCCCACCTCATTATCATATTGGCCTCAATCCAAAATAAGG

TATATTATTGATGATG
```

Embodiments

The following list of embodiments is intended to complement, rather than displace or supersede, the previous descriptions.

Embodiment 1. A self-replicating RNA molecule comprising an RNA encoding a polypeptide of SEQ ID NO: 541 or SEQ ID NO: 543.

Embodiment 2. The self-replicating RNA molecule of embodiment 1, wherein the RNA corresponds a polynucleotide of SEQ ID NO: 542 or SEQ ID NO: 544.

Embodiment 3. A self-replicating RNA molecule comprising an RNA encoding one or more polypeptides selected from the group consisting of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 379, 381, 383, 385, 387, 388, 389, 390, 391, 392, 393, 394, 395, 396, 397, 398, 399, 400, 401, 402, 403, 404, 405, 406, 407, 408, 426, 427, 428, 429, 430, 431, 432, 433, 434, 435, 436, 437, 438, 439, 440, 441, 442, 443, 444, 445, 446 and 447, and fragments thereof.

Embodiment 4. The self-replicating RNA molecule of embodiment 3, wherein the RNA encodes one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof.

Embodiment 5. The self-replicating RNA molecule of embodiment 3 or 4, comprising an RNA corresponding to one or more polynucleotides selected from the group consisting of SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 380, 382, 384, 386, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491, 492, 493, 494, 495, 496, 497, 498, 499, 500, 501, 503, 504, 505, 506, 507, 508, 509, 510, 511, 512, 513, 514, 515, 516, 517, 519, 520, 521, 522, 523, 524, 525, 528, 529, 530, 531, 532, 533, 534, 535, 536, 537, 538, 539 and 540, and fragments thereof.

Embodiment 6. The self-replicating RNA molecule of embodiment 5, wherein the RNA corresponds to one or more polynucleotides selected from the group consisting of SEQ ID NOs: 276, 382, 334, 338, 270, 254, 310, 326, 272, 306, 252, 246, 262, 266, 318, 256, 278, 298, 286, 448, 450, 453, 455, 380, 344, 212, 350, 214, 216, 222, 220, 226, 346, 354, 236, 224, 168, 172, 20, 24 and 178, and fragments thereof.

Embodiment 7. The self-replicating RNA molecule of any one of the previous embodiments, wherein the RNA encodes a polypeptide of SEQ ID NOs: 541, 543, 550, 552, 554, 555, 556, 557, 558, 559, 623, 624, 625 or 626.

Embodiment 8. The self-replicating RNA molecule of any one of the previous embodiments, comprising one or more of the following:

a. one or more nonstructural genes nsP1, nsP2, nsP3, and nsP4;
b. at least one of a DLP motif, a 5' UTR, a 3'UTR, and a Poly A;
c. a subgenomic promoter; and
d. a RNA encoding for one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177, and fragments thereof; operably linked to the subgenomic promoter.

Embodiment 9. The self-replicating RNA molecule of any one of the previous embodiments, comprising one or more of the following:

a. one or more nonstructural genes nsP1, nsP2, nsP3, and nsP4;
b. at least one of a DLP motif, 5' UTR, a 3'UTR, and a Poly A;
c. a subgenomic promoter; and
d. RNA encoding a one or more polypeptides selected from the group consisting of SEQ ID NOs: 541, 543, 550, 552, 554, 555, 556, 557, 558, 559, 623, 624, 625, or 626. and fragments thereof; operably linked to the subgenomic promoter.

Embodiment 10. The self-replicating RNA molecule of embodiment 8 or 9, further comprising a coding sequence for an autoprotease peptide.

Embodiment 11. The self-replicating RNA molecule of embodiment 10, comprising a DLP motif and a coding sequence for an autoprotease peptide operably linked downstream of the DLP motif and upstream to the polynucleotide encoding the one or more polypeptides.

Embodiment 12. The self-replicating RNA molecule of embodiment 11, wherein the autoprotease peptide is selected from the group consisting of porcine teschovirus-1 2A (P2A), foot-and-mouth disease virus (FMDV) 2A (F2A), Equine Rhinitis A Virus (ERAV) 2A (E2A), Thosea asigna virus 2A (T2A), cytoplasmic polyhedrosis virus 2A (BmCPV2A), Flacherie Virus 2A (BmIFV2A), and a combination thereof.

Embodiment 13. The self-replicating RNA molecule of embodiment 12, wherein in autoprotease peptide is porcine teschovirus-1 2A (P2A).

Embodiment 14. The self-replicating RNA molecule of embodiment 11, wherein the DLP motif comprises at least one RNA-stem-loop.

Embodiment 15. The self-replicating RNA molecule of embodiment 14, wherein the downstream loop is placed upstream of the non-structural protein 1 (nsP1).

Embodiment 16. The self-replicating RNA molecule of embodiment 15, wherein the downstream loop placed upstream of the nsP1 is joined to the nsP1 by a porcine teschovirus-1 2A (P2A) ribosome skipping element.

Embodiment 17. The self-replicating RNA molecule of any one of the previous embodiments, comprising nonstructural genes nsP1, nsP2, nsP3, and nsP4, and wherein the self-replicating RNA molecule does not encode a functional viral structural protein.

Embodiment 18. The self-replicating RNA molecule of any one of the previous embodiments, wherein a fragment of the nsP1 is duplicated downstream of the 5'-UTR and upstream of the DLP.

Embodiment 19. The self-replicating RNA molecule of embodiment 18, wherein the first 193 nucleotides of nsP1 are duplicated downstream of the 5' UTR and upstream of the DLP.

Embodiment 20. The self-replicating RNA molecule of any one of the previous embodiments, wherein the self-replicating RNA is an alphavirus-derived RNA replicon.

Embodiment 21. The self-replicating RNA molecule of embodiment 20, wherein the alphavirus is a Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), and Buggy Creek virus. Virulent and avirulent alphavirus strains are both suitable. In some embodiments, the alphavirus RNA replicon is of a Sindbis virus (SIN), a Semliki Forest virus (SFV), a Ross River virus (RRV), a Venezuelan equine encephalitis virus (VEEV), or an Eastern equine encephalitis virus (EEEV).

Embodiment 22. The self-replicating RNA molecule of embodiment 21, wherein the alphavirus is a VEEV.

Embodiment 23. The self-replicating RNA molecule of embodiment 22, comprising a DLP motif placed upstream of a nsP1 derived from Sindbis virus.

Embodiment 24. The self-replicating RNA molecule of embodiment 23, comprising non-VEEV nonstructural proteins nsP1, nsP2, nsP3, and nsP4.

Embodiment 25. A DNA construct comprising the vector of SEQ ID NO: 981 and the self-replicating RNA molecule of any one of the previous embodiments.

Embodiment 26. A composition comprising the self-replicating RNA molecule of any one of embodiments 1-24 or the DNA construct of embodiment 25, and a pharmaceutically acceptable carrier.

Embodiment 27. The composition of embodiment 26, wherein the self-replicating RNA molecule is encapsulated in, bound to, or adsorbed on a liposome, a lipoplex, a lipid nanoparticle, or combinations thereof, preferably the self-replicating RNA molecule is encapsulated in a lipid nanoparticle.

Embodiment 28. The composition of embodiment 27, wherein the lipid nanoparticle comprises an mRNA, a cationic lipid, a phospholipid, cholesterol and/or a conjugated lipid.

Embodiment 29. The composition of embodiment 28, wherein the cationic lipid comprises a protonatable tertiary amine.

Embodiment 30. The composition of embodiment 29, wherein the cationic lipid is di((Z)-non-2-en-1-yl) 8,8'-((((2-(dimethylamino)ethyl)thio)carbonyl)azanediyl)dioctanoate.

Embodiment 31. The composition of embodiment 28, wherein the conjugated lipid is a PEG-lipid.

Embodiment 32. The composition of embodiment 31, wherein the PEG-lipid is a DMG-PEG-2000.

Embodiment 33. The composition of embodiment 28, wherein the phospholipid is DSPC.

Embodiment 34. The composition of embodiment 28, wherein the lipid nanoparticle comprises a cationic lipid, a switterion lipid, a cholesterol, and a conjugated lipid combined in a molar ratio of 50:7:40:3, respectively.

Embodiment 35. A kit comprising the self-replicating RNA molecule of any one of embodiments 1-24, the DNA construct of embodiment 25, or the composition of any one of embodiments 26-34, and instructions for using the kit in treating a prostate cancer in a subject in need thereof.

Embodiment 36. A method of immunizing an individual, comprising administering to the individual the self-replicating RNA molecule of any one of embodiments 1-24, the DNA construct of embodiment 25, or the composition of any one of embodiments 26-34.

Embodiment 37. A method of treating or preventing prostate cancer in a subject, comprising administering to the subject the self-replicating RNA molecule of any one of embodiments 1-24, the DNA construct of embodiment 25, or the composition of any one of embodiments 26-34.

Embodiment 38. The method of embodiment 37, wherein the prostate cancer is a relapsed prostate cancer, a refractory prostate cancer, a metastatic prostate cancer, a castration resistant prostate cancer, or any combination thereof.

Embodiment 39. The method of embodiment 37 or 38, wherein the subject is treatment naïve.

Embodiment 40. The method of any one of embodiments 36-38, wherein the subject has received androgen deprivation therapy.

Embodiment 41. The method of any one of embodiments 36-40, wherein the subject has an elevated level of prostate specific antigen (PSA).

Embodiment 42. The method of any one of embodiments 36-41, comprising administering an additional cancer therapeutic agent to the subject.

Embodiment 43. The method of embodiment 42, wherein the additional cancer therapeutic agent is a surgery, a chemotherapy, an androgen deprivation therapy, radiation, a checkpoint inhibitor, a targeted therapy, or any combination thereof.

Embodiment 44. The method of embodiment 43, wherein the additional cancer therapeutic agent is a CTLA-4 antibody, a CTLA4 ligand, a PD-1 axis inhibitor, a PD-L1 axis inhibitor, a TLR agonist, a CD40 agonist, an OX40 agonist, hydroxyurea, ruxolitinib, fedratinib, a 41BB agonist, aa CD28 agonist, a STING antagonist, a RIG-1 antagonist, TCR-T therapy, CAR-T therapy, FLT3 ligand, aluminum sulfate, BTK inhibitor, CD38 antibody, CDK inhibitor, CD33 antibody, CD37 antibody, CD25 antibody, GM-CSF inhibitor, IL-2, IL-15, IL-7, CD3 redirection molecules, pomalimib, IFNγ, IFNα, TNFα, VEGF antibody, CD70 antibody, CD27 antibody, BCMA antibody or GPRC5D antibody, or any combination thereof.

Embodiment 45. The method of embodiment 43, wherein the checkpoint inhibitor is ipilimumab, cetrelimab, pembrolizumab, nivolumab, sintilimab. cemiplimab, toripalimab, camrelizumab, tislelizumab, dostralimab, spartalizumab, prolgolimab, balstilimab, budigalimab, sasanlimab, avelumab, atezolizumab, durvalumab, envafolimab, or iodapolimab, or any combination thereof.

Embodiment 46. A method of treating or preventing a prostate cancer in a subject, the method comprising administering to the subject:

a. a first vaccine comprising a polynucleotide or RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177; and b. a second vaccine comprising a polynucleotide or RNA encoding one or more polypeptides selected from the group consisting of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 and 177.

Embodiment 47. The method of embodiment 46, comprising administering to the subject a. a first vaccine comprising a polynucleotide or RNA encoding a polypeptide selected from the group consisting of SEQ ID NOs: 541, 543, 550, 552, 554, 555, 556, 557, 558, 559, 623, 624, 625 or 626; and b. a second vaccine comprising a polynucleotide or RNA encoding a polypeptide selected from the group consisting of SEQ ID NOs: 541, 543, 550, 552, 554, 555, 556, 557, 558, 559, 623, 624, 625 or 626.

Embodiment 48. The method of embodiment 46 or 47, wherein the first vaccine and the second vaccine are recombinant viruses derived from GAd20, MV A, or Ad26, or a self-replicating RNA molecule.

Embodiment 49. The method of embodiment 48, wherein the first vaccine and the second vaccine are capable of eliciting a cellular immune response in the subject.

Embodiment 50. The method of embodiment 49, wherein the cellular immune response is specific against one or more fragments of the polypeptide of SEQ ID NOs: 275, 381, 333, 337, 269, 253, 309, 325, 271, 305, 251, 245, 261, 265, 317, 255, 277, 297, 285, 437, 439, 442, 444, 379, 343, 211, 349, 213, 215, 221, 219, 225, 345, 353, 235, 223, 167, 171, 19, 23 or 177, or any combination thereof.

Embodiment 51. The method of embodiment 50, wherein the cellular immune response is specific against one or more fragments of the polypeptide of SEQ ID NOs: 541, 543, 550, 552, 554, 555, 556, 557, 558, 559, 623, 624, 625 or 626.

Embodiment 52. The method of any one of embodiments 49-51, wherein the cellular immune response is activation of vaccine-specific $CD8^+$ T cells, $CD4^+$ T cells, or $CD8^+$ T cells and $CD4^+$ T cells, wherein activation is assessed by increased production of TNFα, IFNγ, or TNFα and IFNγ by $CD8^+$ T cells, $CD4^+$ T cells, or $CD8^+$ T cells and $CD4^+$ T cells.

Embodiment 53. The method of any one of embodiments 46-52, wherein the first vaccine, the second vaccine, or both the first vaccine and the second vaccine comprises an RNA vaccine.

Embodiment 54. The method of any one of embodiments 46-52, wherein the first vaccine, the second vaccine, or both the first vaccine and the second vaccine comprises a self-replicating RNA molecule.

Embodiment 55. The method of embodiment 54, wherein the first vaccine comprises a recombinant virus derived from GAd20, Ad26, or MV A, and the second vaccine is a self-replicating RNA molecule.

Embodiment 56. The method of embodiment 55, wherein the first vaccine comprises Ad26.

Embodiment 57. The method of embodiment 55, wherein the first vaccine comprises GAd20.

Embodiment 58. The method of embodiment 55, wherein the first vaccine comprises MV A.

Embodiment 59. The method of embodiment 54, wherein the first vaccine comprises a self-replicating RNA molecule and the second vaccine comprises a recombinant virus derived from Ad26, GAd20, or MV A.

Embodiment 60. The method of embodiment 59, wherein the second vaccine comprises Ad26.

Embodiment 61. The method of embodiment 59, wherein the second vaccine comprises GAd20.

Embodiment 62. The method of embodiment 59, wherein the second vaccine comprises MV A.

Embodiment 63. The method of embodiment 56, wherein the first vaccine is a recombinant virus derived from Ad26 comprising a polynucleotide encoding a polypeptide of SEQ ID NOs: 541, 550, 554, 555, 556, 623 or 624 and the second vaccine is a self-replicating RNA molecule comprising a polynucleotide encoding a polypeptide of SEQ ID NOs 541, 543, 550, 552, 554, 555, 556, 557, 558, 559, 623, 624, 625 or 626.

Embodiment 64. The method of embodiment 57, wherein the first vaccine is a recombinant virus derived from GAd20 comprising a polynucleotide encoding a polypeptide of SEQ ID NOs: 541, 550, 554, 555, 556, 623 or 624 and the second vaccine is a self-replicating RNA molecule comprising a polynucleotide encoding a polypeptide of SEQ ID NOs 541, 543, 550, 552, 554, 555, 556, 557, 558, 559, 623, 624, 625 or 626.

Embodiment 65. The method of embodiment 58, wherein the first vaccine is a recombinant virus derived from MV A comprising a polynucleotide encoding a polypeptide of SEQ ID NOs: 543, 552, 557, 558, 559, 625 or 626 and the second vaccine is a self-replicating RNA molecule comprising a polynucleotide encoding a polypeptide of SEQ ID NOs 541, 543, 550, 552, 554, 555, 556, 557, 558, 559, 623, 624, 625 or 626.

Embodiment 66. The method of embodiment 60, wherein the first vaccine is a self-replicating RNA molecule comprising a polynucleotide encoding a polypeptide of SEQ ID NOs 541, 543, 550, 552, 554, 555, 556, 557, 558, 559, 623, 624, 625 or 626 and the second vaccine is a recombinant virus derived from Ad26 comprising a polynucleotide encoding a polypeptide of SEQ ID NOs: 541, 550, 554, 555, 556, 623 or 624.

Embodiment 67. The method of embodiment 61, wherein the first vaccine is a self-replicating RNA molecule comprising a polynucleotide encoding a polypeptide of SEQ ID NOs 541, 543, 550, 552, 554, 555, 556, 557, 558, 559, 623, 624, 625 or 626 and the second vaccine is a recombinant virus derived from GAd20 comprising a polynucleotide encoding a polypeptide of SEQ ID NOs: 541, 550, 554, 555, 556, 623 or 624.

Embodiment 68. The method of embodiment 62, wherein the first vaccine is a self-replicating RNA molecule comprising a polynucleotide encoding a polypeptide of SEQ ID NOs 541, 543, 550, 552, 554, 555, 556, 557, 558, 559, 623, 624, 625 or 626 and the second vaccine is a recombinant virus derived from MVA comprising a polynucleotide encoding a polypeptide of SEQ ID NOs: 543, 552, 557, 558, 559, 625 or 626.

Embodiment 69. The method of any of embodiments 48-68, wherein the self-replicating RNA molecule is an alphavirus.

Embodiment 70. The method of embodiment 69, wherein the alphavirus is derived from Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middleburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), and Buggy Creek virus. Virulent and avirulent alphavirus strains are both suitable. In some embodiments, the alphavirus RNA replicon is of a Sindbis virus (SIN), a Semliki Forest virus (SFV), a Ross River virus (RRV), a Venezuelan equine encephalitis virus (VEEV), or an Eastern equine encephalitis virus (EEEV).

Embodiment 71. The method of embodiment 70, wherein the alphavirus is a Venezuelan equine encephalitis virus (VEEV).

Embodiment 72. The method of any one of embodiments 46-71, wherein the subject has, is suspected to have, or is suspected to develop prostate cancer.

Embodiment 73. The method of any one of embodiments 46-72, wherein the prostate cancer is a relapsed prostate cancer, a refractory prostate cancer, a metastatic prostate cancer, a castration resistant prostate cancer, or any combination thereof.

Embodiment 74. The method of any one of embodiments 46-73, wherein the subject is treatment naïve.

Embodiment 75. The method of any one of embodiments 46-73, wherein the subject has received androgen deprivation therapy.

Embodiment 76. The method of any one of embodiments 46-75, wherein the subject has an elevated level of PSA.

Embodiment 77. The method of any one of embodiments 46-76, comprising administering an additional cancer therapeutic agent to the subject.

Embodiment 78. The method of embodiment 77, wherein the additional cancer therapeutic agent is a surgery, a chemotherapy, an androgen deprivation therapy, radiation, a checkpoint inhibitor, a targeted therapy, or any combination thereof.

Embodiment 79. The method of embodiment 78, wherein the additional cancer therapeutic agent is a CTLA-4 antibody, a CTLA4 ligand, a PD-1 axis inhibitor, a PD-L1 axis inhibitor, a TLR agonist, a CD40 agonist, an OX40 agonist, hydroxyurea, ruxolitinib, fedratinib, a 41BB agonist, aa CD28 agonist, a STING antagonist, a RIG-1 antagonist, TCR-T therapy, CAR-T therapy, FLT3 ligand, aluminum sulfate, BTK inhibitor, CD38 antibody, CDK inhibitor, CD33 antibody, CD37 antibody, CD25 antibody, GM-CSF inhibitor, IL-2, IL-15, IL-7, CD3 redirection molecules, pomalimib, IFNγ, IFNα, TNFα, VEGF antibody, CD70 antibody, CD27 antibody, BCMA antibody or GPRC5D antibody or any combination thereof.

Embodiment 80. The method of embodiment 78, wherein the checkpoint inhibitor is ipilimumab, cetrelimab, pembrolizumab, nivolumab, sintilimab. cemiplimab, toripalimab, camrelizumab, tislelizumab, dostralimab, spartalizumab, prolgolimab, balstilimab, budigalimab, sasanlimab, avelumab, atezolizumab, durvalumab, envafolimab, or iodapolimab, or any combination thereof.

Embodiment 81. The method of any one of embodiments 46-80, wherein the first vaccine is administered one or more times to the subject.

Embodiment 82. The method of any one of embodiments 46-80, wherein the second vaccine is administered one or more times to the subject.

Embodiment 83. The method of any one of embodiments 46-82, wherein the first vaccine is administered between about 1-16 weeks prior to administering the second vaccine.

Embodiment 84. A polypeptide comprising:

a TCE domain, a domain comprising an antigenic sequence, and a tag, wherein the TCE domain comprises the amino acid sequence of SEQ ID NO: 549;

the antigenic sequence comprises an amino acid sequence selected from the group consisting of SEQ ID NOs: 541, 543, 550, 552, 554, 555, 556, 557, 558, 559, 623, 624, 625, or 626; and the tag comprises the amino acid sequence of SEQ ID NO: 627.

Embodiment 85. The polypeptide of embodiment 84, wherein the polypeptide comprises:

the TCE domain comprising the amino acid sequence of SEQ ID NO: 549;

the antigenic sequence comprising an amino acid sequence of SEQ ID NO: 541; and the tag comprising the amino acid sequence of SEQ ID NO: 627.

Embodiment 86. The polypeptide of embodiment 84, wherein the polypeptide comprises:

the TCE domain comprising the amino acid sequence of SEQ ID NO: 549;

the antigenic sequence comprising an amino acid sequence of SEQ ID NO: 543; and the tag comprising the amino acid sequence of SEQ ID NO: 627.

Embodiment 87. A vaccine comprising the polypeptide of any one of embodiments 84-86.

Embodiment 88. The vaccine of embodiment 87, wherein the vaccine comprises a recombinant virus derived from GAd20, MV A, or Ad26, or a self-replicating RNA molecule.

Embodiment 89. The vaccine of embodiment 88, wherein the recombinant vims is derived from GAd20 and the polypeptide comprises the polypeptide of SEQ ID NO: 541.

Embodiment 90. The vaccine of embodiment 88, wherein the recombinant vims is derived from MVA and the polypeptide comprises the polypeptide of SEQ ID NO: 543.

Embodiment 91. The vaccine of embodiment 88, wherein the recombinant vims is derived from Ad26 and the polypeptide comprises the polypeptide of SEQ ID NO: 541 or 543.

Embodiment 92. The vaccine of embodiment 88, wherein the vaccine comprises a self-replicating RNA molecule comprising the polypeptide of SEQ ID NO: 541 or 543.

Embodiment 93. A method of immunizing an individual, comprising administering to the individual the polypeptide of any one of embodiments 84-86, or the vaccine of any one of embodiments 87-92.

Embodiment 94. A method of treating or preventing prostate cancer in a subject, comprising administering to the subject the polypeptide of any one of embodiments 84-86, or the vaccine of any one of embodiments 87-92

SEQUENCE LISTING (999 sequences)

SEQ ID NO: 1 - protein, 17 aa, Homo sapiens
SSCMGGMNQRPILTIIT

SEQ ID NO: 2 - DNA, 51 bp, Homo sapiens
agttcctgcatgggcggcatgaaccagaggcccatcctcaccatcatcaca

SEQ ID NO: 3 - protein, 17 aa, Homo sapiens
SSCMGGMNWRPILTIIT

SEQ ID NO: 4 - DNA, 51 bp, Homo sapiens
agttcctgcatgggcggcatgaattggaggcccatcctcaccatcatcaca

SEQ ID NO: 5 - protein, 17 aa, Homo sapiens
LGRNSFEVCVCACPGRD

SEQ ID NO: 6 - DNA, 51 bp, Homo sapiens
ctgggacggaacagctttgaggtgtgtgtttgtgcctgtcctgggagagac

SEQ ID NO: 7 - protein, 17 aa, Homo sapiens
LGRNSFEVLVCACPGRD

SEQ ID NO: 8 - DNA, 51 bp, Homo sapiens
ctgggacggaacagctttgaggtgcttgtttgtgcctgtcctgggagagac

SEQ ID NO: 9 - protein, 17 aa, Homo sapiens
MCNSSCMGSMNRRPILT

SEQ ID NO: 10 - DNA, 51 bp, Homo sapiens
atgtgtaacagttcctgcatgggcagcatgaaccggaggcccatcctcacc

SEQ ID NO: 11 - protein, 17 aa, Homo sapiens
FRHSVVVPCEPPEVGSD

SEQ ID NO: 12 - DNA, 51 bp, Homo sapiens
tttcgacatagtgtggtggtgccctgtgagccgcctgaggttggctctgac

SEQ ID NO: 13 - protein, 17 aa, Homo sapiens
VCACPGRDWRTEEENLR

SEQ ID NO: 14 - DNA, 51 bp, Homo sapiens
gtttgtgcctgtcctgggagagattggcgcacagaggaagagaatctccgc

SEQ ID NO: 15 - protein, 17 aa, Homo sapiens
FVQGKDWGCKKFIRRDF

SEQ ID NO: 16 - DNA, 51 bp, Homo sapiens
tttgtgcaaggcaaagactggggatgcaagaaattcatccgtagagatttt

SEQ ID NO: 17 - protein, 17 aa, Homo sapiens
FVQGKDWGIKKFIRRDF

SEQ ID NO: 18 - DNA, 51 bp, Homo sapiens
tttgtgcaaggcaaagactggggaatcaagaaattcatccgtagagatttt

SEQ ID NO: 19 - protein, 17 aa, Homo sapiens
FVQGKDWGLKKFIRRDF

SEQ ID NO: 20 - DNA, 51 bp, Homo sapiens
tttgtgcaaggcaaagactggggattaaagaaattcatccgtagagatttt

SEQ ID NO: 21 - protein, 17 aa, Homo sapiens
FVQGKDWGSKKFIRRDF

SEQ ID NO: 22 - DNA, 51 bp, Homo sapiens
tttgtgcaaggcaaagactggggatccaagaaattcatccgtagagatttt

SEQ ID NO: 23 - protein, 17 aa, Homo sapiens
FVQGKDWGVKKFIRRDF

SEQ ID NO: 24 - DNA, 51 bp, Homo sapiens
tttgtgcaaggcaaagactggggagtcaagaaattcatccgtagagatttt

SEQ ID NO: 25 - protein, 17 aa, Homo sapiens
YRFVQGKDCGFKKFIRR

SEQ ID NO: 26 - DNA, 51 bp, Homo sapiens
tataggtttgtgcaaggcaaagactgtggattcaagaaattcatccgtaga

SEQ ID NO: 27 - protein, 17 aa, Homo sapiens
YRFVQGKDGGFKKFIRR

SEQ ID NO: 28 - DNA, 51 bp, Homo sapiens
tataggtttgtgcaaggcaaagacgggggattcaagaaattcatccgtaga

SEQ ID NO: 29 - protein, 17 aa, Homo sapiens
YRFVQGKDLGFKKFIRR

SEQ ID NO: 30 - DNA, 51 bp, Homo sapiens
tataggtttgtgcaaggcaaagactggggattcaagaaattcatccgtaga

SEQ ID NO: 31 - protein, 17 aa, Homo sapiens
YRFVQGKDRGFKKFIRR

SEQ ID NO: 32 - DNA, 51 bp, Homo sapiens
tataggtttgtgcaaggcaaagaccggggattcaagaaattcatccgtaga

SEQ ID NO: 33 - protein, 17 aa, Homo sapiens
YRFVQGKDSGFKKFIRR

SEQ ID NO: 34 - DNA, 51 bp, Homo sapiens
tataggtttgtgcaaggcaaagactcgggattcaagaaattcatccgtaga

SEQ ID NO: 35 - protein, 17 aa, Homo sapiens
YPVGYEATHIYWSLRTN

SEQ ID NO: 36 - DNA, 51 bp, Homo sapiens
tatcccgtgggctacgaggccacgcacatctattggagcctccgcaccaac

SEQ ID NO: 37 - protein, 17 aa, Homo sapiens
MFENGCYLCRQKRFKCE

SEQ ID NO: 38 - DNA, 51 bp, Homo sapiens
atgttcgagaacggctgctacttgtgccgccagaagcgcttcaagtgcgag

SEQ ID NO: 39 - protein, 17 aa, Homo sapiens
GKGSYWTLQPDSGNMFE

SEQ ID NO: 40 - DNA, 51 bp, Homo sapiens
ggcaagggctcctactggacgctgcagccggactccggcaacatgttcgag

SEQ ID NO: 41 - protein, 17 aa, Homo sapiens
GKGSYWTLLPDSGNMFE

SEQ ID NO: 42 - DNA, 51 bp, Homo sapiens
ggcaagggctcctactggacgctgctcccggactccggcaacatgttcgag

SEQ ID NO: 43 - protein, 17 aa, Homo sapiens
GKGSYWTLNPDSGNMFE

SEQ ID NO: 44 - DNA, 51 bp, Homo sapiens
ggcaagggctcctactggacgctgaacccggactccggcaacatgttcgag

SEQ ID NO: 45 - protein, 17 aa, Homo sapiens
GKGSYWTLYPDSGNMFE

SEQ ID NO: 46 - DNA, 51 bp, Homo sapiens
ggcaagggctcctactggacgctgtacccggactccggcaacatgttcgag

SEQ ID NO: 47 - protein, 17 aa, Homo sapiens
CYLRRQKRCKCEKQPGA

SEQ ID NO: 48 - DNA, 51 bp, Homo sapiens
tgctacttgcgccgccagaagcgctgcaagtgcgagaagcagccgggggcc

SEQ ID NO: 49 - protein, 17 aa, Homo sapiens
CYLRRQKRSKCEKQPGA

SEQ ID NO: 50 - DNA, 51 bp, Homo sapiens
tgctacttgcgccgccagaagcgctccaagtgcgagaagcagccgggggcc

SEQ ID NO: 51 - protein, 17 aa, Homo sapiens
IRHSLSFNGCFVKVARS

SEQ ID NO: 52 - DNA, 51 bp, Homo sapiens
atccgccactcgctgtccttcaatggctgcttcgtcaaggtggcacgctcc

SEQ ID NO: 53 - protein, 17 aa, Homo sapiens
IRHSLSFNNCFVKVARS

SEQ ID NO: 54 - DNA, 51 bp, Homo sapiens
atccgccactcgctgtccttcaataactgcttcgtcaaggtggcacgctcc

SEQ ID NO: 55 - protein, 17 aa, Homo sapiens
QQRWQNSICHSLSFNDC

SEQ ID NO: 56 - DNA, 51 bp, Homo sapiens
cagcagcgctggcagaactccatctgccactcgctgtccttcaatgactgc

SEQ ID NO: 57 - protein, 17 aa, Homo sapiens
QQRWQNSISHSLSFNDC

SEQ ID NO: 58 - DNA, 51 bp, Homo sapiens
cagcagcgctggcagaactccatcagccactcgctgtccttcaatgactgc

SEQ ID NO: 59 - protein, 17 aa, Homo sapiens
TLHPDSGNKFENGCYLR

SEQ ID NO: 60 - DNA, 51 bp, Homo sapiens
acgctgcacccggactccggcaacaagttcgagaacggctgctacttgcgc

SEQ ID NO: 61 - protein, 17 aa, Homo sapiens
TLHPDSGNRFENGCYLR

SEQ ID NO: 62 - DNA, 51 bp, Homo sapiens
acgctgcacccggactccggcaacaggttcgagaacggctgctacttgcgc

SEQ ID NO: 63 - protein, 17 aa, Homo sapiens
CHKKNFLHWDIKCSNIL

SEQ ID NO: 64 - DNA, 51 bp, Homo sapiens
tgtcacaaaaagaatttcctgcattgggatattaagtgttctaacattttg

SEQ ID NO: 65 - protein, 17 aa, Homo sapiens
IHCKAGKGQTGVMICAY

SEQ ID NO: 66 - DNA, 51 bp, Homo sapiens
attcactgtaaagctggaaagggacaaactggtgtaatgatatgtgcatat

SEQ ID NO: 67 - protein, 17 aa, Homo sapiens
WLSEDDNHFAAIHCKAG

SEQ ID NO: 68 - DNA, 51 bp, Homo sapiens
tggctaagtgaagatgacaatcattttgcagcaattcactgtaaagctgga

SEQ ID NO: 69 - protein, 17 aa, Homo sapiens
GLGDRHVQSILINEQSA

SEQ ID NO: 70 - DNA, 51 bp, Homo sapiens
ggacttggtgatagacatgtacagagtatcttgataaatgagcagtcagca

SEQ ID NO: 71 - protein, 17 aa, Homo sapiens
GLGDRHVQKILINEQSA

SEQ ID NO: 72 - DNA, 51 bp, Homo sapiens
ggacttggtgatagacatgtacagaaaatcttgataaatgagcagtcagca

SEQ ID NO: 73 - protein, 17 aa, Homo sapiens
NINIGPGDSEWFVVPEG

SEQ ID NO: 74 - DNA, 51 bp, Homo sapiens
aacataaatattggcccaggtgactctgaatggtttgttgttcctgaaggt

SEQ ID NO: 75 - protein, 17 aa, Homo sapiens
NINIGPGDYEWFVVPEG

SEQ ID NO: 76 - DNA, 51 bp, Homo sapiens
aacataaatattggcccaggtgactatgaatggtttgttgttcctgaaggt

SEQ ID NO: 77 - protein, 17 aa, Homo sapiens
FMKQMNDARHGGWTTKM

SEQ ID NO: 78 - DNA, 51 bp, Homo sapiens
ttcatgaaacaaatgaatgatgcacgtcatggtggctggacaacaaaaatg

SEQ ID NO: 79 - protein, 17 aa, Homo sapiens
RDPLSEITKQEKDFLWS

SEQ ID NO: 80 - DNA, 51 bp, Homo sapiens
cgagatcctctctctgaaatcactaagcaggagaaagattttctatggagt

SEQ ID NO: 81 - protein, 17 aa, Homo sapiens
RDPLSEITGQEKDFLWS

SEQ ID NO: 82 - DNA, 51 bp, Homo sapiens
cgagatcctctctctgaaatcactgggcaggagaaagattttctatggagt

SEQ ID NO: 83 - protein, 17 aa, Homo sapiens
RDPLSEITAQEKDFLWS

SEQ ID NO: 84 - DNA, 51 bp, Homo sapiens
cgagatcctctctctgaaatcactgcgcaggagaaagattttctatggagt

SEQ ID NO: 85 - protein, 17 aa, Homo sapiens
SGIHSGATATAPSLSGK

SEQ ID NO: 86 - DNA, 51 bp, Homo sapiens
tctggaatccattctggtgccactgccacagctccttctctgagtggtaaa

SEQ ID NO: 87 - protein, 17 aa, Homo sapiens
HWQQQSYLASGIHSGAT

SEQ ID NO: 88 - DNA, 51 bp, Homo sapiens
cactggcagcaacagtcttacctggcctctggaatccattctggtgccact

SEQ ID NO: 89 - protein, 17 aa, Homo sapiens
HWQQQSYLHSGIHSGAT

SEQ ID NO: 90 - DNA, 51 bp, Homo sapiens
cactggcagcaacagtcttacctgcactctggaatccattctggtgccact

SEQ ID NO: 91 - protein, 17 aa, Homo sapiens
HWQQQSYLVSGIHSGAT

SEQ ID NO: 92 - DNA, 51 bp, Homo sapiens
cactggcagcaacagtcttacctggtctctggaatccattctggtgccact

SEQ ID NO: 93 - protein, 17 aa, Homo sapiens
HWQQQSYLYSGIHSGAT

SEQ ID NO: 94 - DNA, 51 bp, Homo sapiens
cactggcagcaacagtcttacctgtactctggaatccattctggtgccact

SEQ ID NO: 95 - protein, 17 aa, Homo sapiens
SYLDSGIHAGATTTAPS

SEQ ID NO: 96 - DNA, 51 bp, Homo sapiens
tcttacctggactctggaatccatgctggtgccactaccacagctccttct

SEQ ID NO: 97 - protein, 17 aa, Homo sapiens
SYLDSGIHCGATTTAPS

SEQ ID NO: 98 - DNA, 51 bp, Homo sapiens
tcttacctggactctggaatccattgtggtgccactaccacagctccttct

SEQ ID NO: 99 - protein, 17 aa, Homo sapiens
SYLDSGIHFGATTTAPS

SEQ ID NO: 100 - DNA, 51 bp, Homo sapiens
tcttacctggactctggaatccattttggtgccactaccacagctccttct

SEQ ID NO: 101 - protein, 17 aa, Homo sapiens
SYLDSGIHYGATTTAPS

SEQ ID NO: 102 - DNA, 51 bp, Homo sapiens
tcttacctggactctggaatccattatggtgccactaccacagctccttct

SEQ ID NO: 103 - protein, 17 aa, Homo sapiens
SGATTTAPCLSGKGNPE

SEQ ID NO: 104 - DNA, 51 bp, Homo sapiens
tctggtgccactaccacagctccttgtctgagtggtaaaggcaatcctgag

SEQ ID NO: 105 - protein, 17 aa, Homo sapiens
SGATTTAPFLSGKGNPE

SEQ ID NO: 106 - DNA, 51 bp, Homo sapiens
tctggtgccactaccacagctccttttctgagtggtaaaggcaatcctgag

SEQ ID NO: 107 - protein, 17 aa, Homo sapiens
SGATTTAPPLSGKGNPE

SEQ ID NO: 108 - DNA, 51 bp, Homo sapiens
tctggtgccactaccacagctcctcctctgagtggtaaaggcaatcctgag

SEQ ID NO: 109 - protein, 17 aa, Homo sapiens
YVPSEDYYKPSPYDDLT

SEQ ID NO: 110 - DNA, 51 bp, Homo sapiens
tacgtgcccagtgaggactactacaagccctcaccgtatgatgacctcacc

SEQ ID NO: 111 - protein, 17 aa, Homo sapiens
IRKRLKLCTDFKRTGMD

SEQ ID NO: 112 - DNA, 51 bp, Homo sapiens
atccggaagaggctaaagctctgcactgacttcaaacgcacagggatggat

SEQ ID NO: 113 - protein, 17 aa, Homo sapiens
VDGAVFAVFKAVFVLGD

SEQ ID NO: 114 - DNA, 51 bp, Homo sapiens
gtggatggagccgtgtttgctgttttcaaggctgtgtttgtacttggggat

SEQ ID NO: 115 - protein, 17 aa, Homo sapiens
IVDGAVFAGLKAVFVLG

SEQ ID NO: 116 - DNA, 51 bp, Homo sapiens
atcgtggatggagccgtgtttgctggtctcaaggctgtgtttgtacttggg

SEQ ID NO: 117 - protein, 17 aa, Homo sapiens
IVDGAVFALLKAVFVLG

SEQ ID NO: 118 - DNA, 51 bp, Homo sapiens
atcgtggatggagccgtgtttgctcttctcaaggctgtgtttgtacttggg

SEQ ID NO: 119 - protein, 17 aa, Homo sapiens
THTANERRWRGEMRDLF

SEQ ID NO: 120 - DNA, 51 bp, Homo sapiens
acacacactgccaatgagcggcggtggcgtggtgaaatgagggatctcttt

SEQ ID NO: 121 - protein, 17 aa, Homo sapiens
GRFSKVSSRAPMEGGEE

SEQ ID NO: 122 - DNA, 51 bp, Homo sapiens
gggaggttcagcaaggtgtctagtcgagctcccatggagggtggggaagaa

SEQ ID NO: 123 - protein, 17 aa, Homo sapiens
GKTEDLGCRYKLFSRVP

SEQ ID NO: 124 - DNA, 51 bp, Homo sapiens
ggaaagacagaagaccttggttgcaggtacaagttatttagtcgtgtgcca

SEQ ID NO: 125 - protein, 12 aa, Homo sapiens
MNHHQQQQQQKA

SEQ ID NO: 126 - DNA, 36 bp, Homo sapiens
atgaaccaccaccagcagcagcagcagcagaaagcg

SEQ ID NO: 127 - protein, 17 aa, Homo sapiens
HGLVDEQQEVRTISALA

SEQ ID NO: 128 - DNA, 51 bp, Homo sapiens
catggtcttgtggatgagcagcaggaagttcggaccatcagtgctttggcc

SEQ ID NO: 129 - protein, 17 aa, Homo sapiens
VCRHGDRCFRLHNKPTF

SEQ ID NO: 130 - DNA, 51 bp, Homo sapiens
gcatgtcgtcatggagacaggtgctttcggttgcacaataaaccgacgttt

SEQ ID NO: 131 - protein, 17 aa, Homo sapiens
SCTTPQCKCLLAKCCVD

SEQ ID NO: 132 - DNA, 51 bp, Homo sapiens
agttgtactacaccgcaatgcaaatgcctgcttgcaaaatgttgtgttgat

SEQ ID NO: 133 - protein, 17 aa, Homo sapiens
SILSKQVQHKPKTGRSL

SEQ ID NO: 134 - DNA, 51 bp, Homo sapiens
tccatattatctaaacaggttcaacataaaccaaaaactggtcgaagttta

SEQ ID NO: 135 - protein, 17 aa, Homo sapiens
QRIGSGSFATVYKGKWH

SEQ ID NO: 136 - DNA, 51 bp, Homo sapiens
caaagaattggatctggatcatttgcaacagtctacaagggaaagtggcat

SEQ ID NO: 137 - protein, 17 aa, Homo sapiens
GDFGLATVESRWSGSHQ

SEQ ID NO: 138 - DNA, 51 bp, Homo sapiens
ggtgattttggtctagctacagtggaatctcgatggagtgggtcccatcag

SEQ ID NO: 139 - protein, 17 aa, Homo sapiens
QANLRHLCCICGNSFRA

SEQ ID NO: 140 - DNA, 51 bp, Homo sapiens
caagccaaccttcgacatctctgctgcatctgtgggaattcttttagagct

SEQ ID NO: 141 - protein, 17 aa, Homo sapiens
QANLRHLCHICGNSFRA

SEQ ID NO: 142 - DNA, 51 bp, Homo sapiens
caagccaaccttcgacatctctgccacatctgtgggaattcttttagagct

SEQ ID NO: 143 - protein, 17 aa, Homo sapiens
DRCLKKVSKGVEQFEDI

SEQ ID NO: 144 - DNA, 51 bp, Homo sapiens
gatcgctgcctcaagaaggtgtccaagggcgtggagcagtttgaagatatt

SEQ ID NO: 145 - protein, 17 aa, Homo sapiens
IKTWVASNKIKDKRQLI

SEQ ID NO: 146 - DNA, 51 bp, Homo sapiens
atcaagacatgggtagcgtccaacaagatcaaggacaagaggcagcttata

SEQ ID NO: 147 - protein, 17 aa, Homo sapiens
QKFDEALRKSWTTKVNW

SEQ ID NO: 148 - DNA, 51 bp, Homo sapiens
caaaaatttgatgaggcgctcaggaaaagctggactactaaagtgaactgg

SEQ ID NO: 149 - protein, 17 aa, Homo sapiens
WVKPIIIGCHAYGDQYR

SEQ ID NO: 150 - DNA, 51 bp, Homo sapiens
tgggtaaaacctatcatcataggttgtcatgcttatggggatcaatacaga

SEQ ID NO: 151 - protein, 17 aa, Homo sapiens
WVKPIIIGGHAYGDQYR

SEQ ID NO: 152 - DNA, 51 bp, Homo sapiens
tgggtaaaacctatcatcataggtggtcatgcttatggggatcaatacaga

SEQ ID NO: 153 - protein, 17 aa, Homo sapiens
WVKPIIIGHHAYGDQYR

SEQ ID NO: 154 - DNA, 51 bp, Homo sapiens
tgggtaaaacctatcatcataggtcatcatgcttatggggatcaatacaga

SEQ ID NO: 155 - protein, 17 aa, Homo sapiens
YKLVVVGADGVGKSALT

SEQ ID NO: 156 - DNA, 51 bp, Homo sapiens
tataagctggtggtggtgggcgccgacggtgtgggcaagagtgcgctgacc

SEQ ID NO: 157 - protein, 17 aa, Homo sapiens
YKLVVVGARGVGKSALT

SEQ ID NO: 158 - DNA, 51 bp, Homo sapiens
tataagctggtggtggtgggcgcccgcggtgtgggcaagagtgcgctgacc

SEQ ID NO: 159 - protein, 17 aa, Homo sapiens
LDILDTAGKEEYSAMRD

SEQ ID NO: 160 - DNA, 51 bp, Homo sapiens
ttggacatcctggataccgccggaaaggaggagtacagcgccatgcgggac

SEQ ID NO: 161 - protein, 17 aa, Homo sapiens
LDILDTAGLEEYSAMRD

SEQ ID NO: 162 - DNA, 51 bp, Homo sapiens
ttggacatcctggataccgccggcctggaggagtacagcgccatgcgggac

SEQ ID NO: 163 - protein, 17 aa, Homo sapiens
LDILDTAGREEYSAMRD

SEQ ID NO: 164 - DNA, 51 bp, Homo sapiens
ttggacatcctggataccgccggccgggaggagtacagcgccatgcgggac

SEQ ID NO: 165 - protein, 17 aa, Homo sapiens
EGWLHKRGKYIKTWRPR

SEQ ID NO: 166 - DNA, 51 bp, Homo sapiens
gagggttggctgcacaaacgagggaagtacatcaagacctggcggccacgc

SEQ ID NO: 167 - protein, 17 aa, Homo sapiens
IARELHQFAFDLLIKSH

SEQ ID NO: 168 - DNA, 51 bp, Homo sapiens
attgcgagagagctgcatcagttcgcttttgacctgctaatcaagtcacac

SEQ ID NO: 169 - protein, 17 aa, Homo sapiens
IARELHQFGFDLLIKSH

SEQ ID NO: 170 - DNA, 51 bp, Homo sapiens
attgcgagagagctgcatcagttcggttttgacctgctaatcaagtcacac

SEQ ID NO: 171 - protein, 17 aa, Homo sapiens
QPDSFAALHSSLNELGE

SEQ ID NO: 172 - DNA, 51 bp, Homo sapiens
cagcccgactcctttgcagccttgcactctagcctcaatgaactgggagag

SEQ ID NO: 173 - protein, 17 aa, Homo sapiens
QMAVIQYSLMGLMVFAM

SEQ ID NO: 174 - DNA, 51 bp, Homo sapiens
cagatggctgtcattcagtactccttgatggggctcatggtgtttgccatg

SEQ ID NO: 175 - protein, 17 aa, Homo sapiens
QMAVIQYSFMGLMVFAM

SEQ ID NO: 176 - DNA, 51 bp, Homo sapiens
cagatggctgtcattcagtactcctttatggggctcatggtgtttgccatg

SEQ ID NO: 177 - protein, 68 aa, Homo sapiens
QNLQNGGGSRSSATLPGRRRRRWLRRRRQPISVAPAGPPRRPNQKPNPPGGARCVIMRPTWPGTSAFT

SEQ ID NO: 178 - DNA, 204 bp, Homo sapiens
cagaacctgcagaatggaggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcaca

SEQ ID NO: 179 - protein, 33 aa, Homo sapiens
QNLQNGGGGAGLQPHCRGGGGGGGCGGGGSQYQ

SEQ ID NO: 180 - DNA, 102 bp, Homo sapiens
cagaacctgcagaatggaggggggggagcaggtcttcagccacactgccggggcggcggcggcggcggtggctgcggcggcggcggcagccaatatcagtag

SEQ ID NO: 181 - protein, 10 aa, Homo sapiens
NQEKEAEKNY

SEQ ID NO: 182 - DNA, 33 bp, Homo sapiens
aaccaagagaaagaggcagaaaaaaactattga

SEQ ID NO: 183 - protein, 40 aa, Homo sapiens
DAAVSPRGLQHRQGRGNLGWWQSPLRKVRVPKRRMVYHPS

SEQ ID NO: 184 - DNA, 123 bp, Homo sapiens
gatgctgctgtcagtcccagggggctgcagcacaggcaggggagagggaatctggggtggtggcagtctcccctgagaaaagtgagagtccccaaaaggaggatggtttatcatcccagttga

SEQ ID NO: 185 - protein, 33 aa, Homo sapiens
FVVSVVKKNRTCPFRLFVRRMLQFTGNKVLDRP

SEQ ID NO: 186 - DNA, 102 bp, Homo sapiens
tttgtcgtttctgttgtgaaaaaaaacaggacttgcccctttcgtctatttgtcagacgaatgttacaatttactggcaataaagttttggatagaccttaa

SEQ ID NO: 187 - protein, 9 aa, Homo sapiens
RSRRSAIKR

SEQ ID NO: 188 - DNA, 32 bp, Homo sapiens
agaagcagaagatcggctataaaaagataatg

SEQ ID NO: 189 - protein, 24 aa, Homo sapiens
SIIVQERERAERRVRRGQVMEIVD

SEQ ID NO: 190 - DNA, 75 bp, Homo sapiens
agtataattgtacaagagagagagagagcagagagaagggtcagaagaggccaagtgatggaaatagtggattaa

SEQ ID NO: 191 - protein, 34 aa, Homo sapiens
NNLVTEKKHRNVQCHDAVEENGQSSFITSPILHS

SEQ ID NO: 192 - DNA, 107 bp, Homo sapiens
aataacttggtcacagaaaaaaaacacagaaatgtgcaatgtcatgatgcagttgaggaaaatggccaatcatcctttattacatcgccaatattacacagctgaaa

SEQ ID NO: 193 - protein, 48 aa, Homo sapiens
HPQRKRRGVPPSPPLALGPRMQLCTQLARFFPITPPVWHILGPQRHTP

SEQ ID NO: 194 - DNA, 149 bp, Homo sapiens
cacccacagaggaaaaggcggggggtccctccgagcccacccctggctctcggccccaggatgcaactgtgcacccagcttgccagatttttccccattacacccccagtgtggcatatccttggtccccagaggcacaccccttgatc

SEQ ID NO: 195 - protein, 31 aa, Homo sapiens
ASRHHLWGATAGTPAPPPVPTCSPRTLRCLP

SEQ ID NO: 196 - DNA, 98 bp, Homo sapiens
gccagccggcaccatctgtggggggcaacagcgggcacccccgcaccaccccccgtgcccacctgttcacccaggaccctgcgatgcctcccctgacc

SEQ ID NO: 197 - protein, 13 aa, Homo sapiens
GPGEAGGPSPQGG

SEQ ID NO: 198 - DNA, 44 bp, Homo sapiens
gggcctggggaggctgggggcccctcaccccaaggcgggtgagc

SEQ ID NO: 199 - protein, 19 aa, Homo sapiens
GGGPSGSGEAPTSPSALRT

SEQ ID NO: 200 - DNA, 62 bp, Homo sapiens
ggcggggggcccagcggctcaggggaggctcccacttctccttcagccctgaggacatgaaa

SEQ ID NO: 201 - protein, 23 aa, Homo sapiens
GNPDVPPPVLFKADQSESSLSSG

SEQ ID NO: 202 - DNA, 72 bp, Homo sapiens
ggaaatccagatgtcccaccccccgtcctcttcaaggcagatcagagcgagagttctttgtcaagtgggtag

SEQ ID NO: 203 - protein, 10 aa, Homo sapiens
AFCYCGEKVP

SEQ ID NO: 204 - DNA, 35 bp, Homo sapiens
gctttttgttactgtggggaaaaagttccttagga

SEQ ID NO: 205 - protein, 16 aa, Homo sapiens
TLHPDSGNGCYLRRQK

SEQ ID NO: 206 - DNA, 50 bp, Homo sapiens
acgctgcacccggactccggcaacggctgctacttgcgccgccagaagcg

SEQ ID NO: 207 - protein, 16 aa, Homo sapiens
LHPDSGNMYGCYLRRQ

SEQ ID NO: 208 - DNA, 53 bp, Homo sapiens
acgctgcacccggactccggcaacatgtacggctgctacttgcgccgccagaa

SEQ ID NO: 209 - protein, 17 aa, Homo sapiens
LHPDSGNMCCYLRRQKR

SEQ ID NO: 210 - DNA, 51 bp, Homo sapiens
ctgcacccggactccggcaacatgtgctgctacttgcgccgccagaagcgc

SEQ ID NO: 211 - protein, 16 aa, Homo sapiens
CGASACDVSLIAMDSA

SEQ ID NO: 212 - DNA, 48 bp, Homo sapiens
tgcggggcctctgcctgtgatgtctccctcattgctatggacagtgct

SEQ ID NO: 213 - protein, 16 aa, Homo sapiens
TEYNQKLQVNQFSESK

SEQ ID NO: 214 - DNA, 48 bp, Homo sapiens
accgaatacaaccagaaattacaagtgaatcaatttagtgaatccaaa

SEQ ID NO: 215 - protein, 24 aa, Homo sapiens
TEISCCTLSSEENEYLPRPEWQLQ

SEQ ID NO: 216 - DNA, 72 bp, Homo sapiens
acagaaatttcatgttgcaccctgagcagtgaggagaatgaataccttccaagaccagagtggcagctccag

SEQ ID NO: 217 - protein, 16 aa, Homo sapiens
GLVSFGEHFCLPCALC

SEQ ID NO: 218 - DNA, 50 bp, Homo sapiens
gggctggtgtccttcggggagcacttttgtctgccctgcgccctctgcca

SEQ ID NO: 219 - protein, 16 aa, Homo sapiens
NSKMALNSEALSVVSE

SEQ ID NO: 220 - DNA, 48 bp, Homo sapiens
aacagcaagatggctttgaactcagaagccttatcagttgtgagtgag

SEQ ID NO: 221 - protein, 14 aa, Homo sapiens
CEERGAAGSLISCE

SEQ ID NO: 222 - DNA, 42 bp, Homo sapiens
tgtgaggagcgcggcgcggcaggaagccttatcagttgtgag

SEQ ID NO: 223 - protein, 69 aa, Homo sapiens
LWFQSSELSPTGAPWPSRRPTWRGTTVSPRTATSSARTCCGTKWPSSQEAALGLGSGLLRFSCGTAAIR

SEQ ID NO: 224 - DNA, 207 bp, Homo sapiens
ctgtggttccagagcagtgagctgtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacgg

SEQ ID NO: 225 - protein, 70 aa, Homo sapiens
WGMELAASRRFSWDHHSAGGPPRVPSVRSGAAQVQPKDPLPLRTLAGCLARTAHLRPGAESLPQPQLHCT

SEQ ID NO: 226 - DNA, 210 bp, Homo sapiens
tgggggatggagttggcagcgtctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcaca

SEQ ID NO: 227 - protein, 28 aa, Homo sapiens
KEQILAVASLVSSQSIHPSWGQSPLSRI

SEQ ID NO: 228 - DNA, 84 bp, Homo sapiens
aaggaacagattttagctgtggccagtctcgtttcctctcagtccatccacccttcatggggccagagccctctctccagaatc

SEQ ID NO: 229 - protein, 14 aa, Homo sapiens
LELELSEGVCFRLR

SEQ ID NO: 230 - DNA, 42 bp, Homo sapiens
ctggagctggagctgtcggaaggagtctgcttcagattaaga

SEQ ID NO: 231 - protein, 17 aa, Homo sapiens
QQLRIFCAAMASNEDFS

SEQ ID NO: 232 - DNA, 52 bp, Homo sapiens
cagcagctaaggatattttgtgcagccatggcctccaacgaagatttctcca

SEQ ID NO: 233 - protein, 31 aa, Homo sapiens
DGFSGSLFAVVTRRCYFLKWRTIFPQSLMWL

SEQ ID NO: 234 - DNA, 93 bp, Homo sapiens
gacgggtttagcggcagcctcttcgcagttgtcaccagacgctgttacttcctaaaatggcggacaatcttcccacagagtttgatgtggtta

SEQ ID NO: 235 - protein, 16 aa, Homo sapiens
KMHFSLKEHPPPPCPP

SEQ ID NO: 236 - DNA, 48 bp, Homo sapiens
aaaatgcacttctccctcaaggagcacccaccgcccccttgcccgcct

SEQ ID NO: 237 - protein, 31 aa, Homo sapiens
DLRRVATYCAPLPSSWRPGTGTTIPPRMRSC

SEQ ID NO: 238 - DNA, 93 bp, Homo sapiens
gatctgcgccgggtcgccacatactgcgctcctttaccctcatcgtggaggcctgggactgggacaacgataccaccccgaatgaggagctgc

SEQ ID NO: 239 - protein, 48 aa, Homo sapiens
LQERMELLACGAERGAGGWGGGGGGGGGDRRGGGGSAPALADFAGGRG

SEQ ID NO: 240 - DNA, 144 bp, Homo sapiens
ttgcaggagcggatggagttgcttgcctgcggagccgagcgcggggccggcggctgggggggaggcggtggcggcggcggcggcgaccgaagaggaggaggaggaagcgcgccagctcttgcagactttgcaggcggccgaggg

SEQ ID NO: 241 - protein, 47 aa, Homo sapiens
LTFLDFIQVTLRVMSGSQMENGSSYFFKPFSWGLGVGLSAWLCVMLT

SEQ ID NO: 242 - DNA, 141 bp, Homo sapiens
ctgacgtttttagatttcatccaggtaacgttgagagtaatgtcaggatctcaaatggaaaacggaagttcctattttttcaagcccttttcatggggtctgggggtgggactctcggcctggctgtgtgtaatgttaact

SEQ ID NO: 243 - protein, 51 aa, Homo sapiens
FMIGELVGELCCQLTFRLPFLESLCQAVVTQALRFNPSFQEVCIYQDTDLM

SEQ ID NO: 244 - DNA, 153 bp, Homo sapiens
ttcatgattggagaacttgtaggtgagttgtgttgccaactcactttccgtttacctttcctcgagagtctttgtcaagctgtagttacacaggctttgaggtttaacccatcttttcaggaagtttgtatttatcaagacactgatctcatg

SEQ ID NO: 245 - protein, 16 aa, Homo sapiens
VAMMVPDRQVHYDFGL

SEQ ID NO: 246 - DNA, 48 bp, Homo sapiens
gttgctatgatggttcctgatagacaggttcattatgactttggattg

SEQ ID NO: 247 - protein, 24 aa, Homo sapiens
WCPLDLRLGSTGCLTCRHHQTSHE

SEQ ID NO: 248 - DNA, 72 bp, Homo sapiens
tggtgtccgctggatcttagactcggttccactggatgtctcacatgcagacatcatcaaacgtcacatgag

SEQ ID NO: 249 - protein, 25 aa, Homo sapiens
VVGRRHETAPQPLLVPDRAGGEGGA

SEQ ID NO: 250 - DNA, 75 bp, Homo sapiens
gtcgtgggaaggcgtcatgaaacagctcctcaacccctgctggtgcccgaccgagctggtggtgaagggggagca

SEQ ID NO: 251 - protein, 17 aa, Homo sapiens
DYWAQKEKISIPRTHLC

SEQ ID NO: 252 - DNA, 51 bp, Homo sapiens
gactactgggctcaaaaggagaagatcagcatccccagaacacacctgtgt

SEQ ID NO: 253 - protein, 18 aa, Homo sapiens
DYWAQKEKGSSSFLRPSC

SEQ ID NO: 254 - DNA, 54 bp, Homo sapiens
gactactgggctcaaaaggagaagggatcatcttcattcctgcgaccatcctgt

SEQ ID NO: 255 - protein, 14 aa, Homo sapiens
LVLGVLSGHSGSRL

SEQ ID NO: 256 - DNA, 42 bp, Homo sapiens
cttgtacttggtgtattgagcgggcacagtggctcacgccta

SEQ ID NO: 257 - protein, 25 aa, Homo sapiens
PVPTATPGVRSVTSPQGLGLFLKFI

SEQ ID NO: 258 - DNA, 75 bp, Homo sapiens
cctgtcccaactgctacacctggggtaagatcagtgactagtccccaggggctgggccttttccttaagtttatt

SEQ ID NO: 259 - protein, 28 aa, Homo sapiens
KENDVREVCDVYLQMQIFFHFKFRSYFH

SEQ ID NO: 260 - DNA, 84 bp, Homo sapiens
aaggaaaatgatgtccgtgaggtctgtgatgtgtatttacaaatgcagatcttcttccattttaagttcagaagttactttcat

SEQ ID NO: 261 - protein, 90 aa, Homo sapiens
VPFRELKNQRTAQGAPGIHHAASPVAANLCDPARHAQHTRIPCGAGQVRAGRGPEAGGGVLQPQRPAPEKPGCPCRRGQPRLHTVKMWRA

SEQ ID NO: 262 - DNA, 270 bp, Homo sapiens
gtgcccttccgggagctcaagaaccagagaacagcacaaggggctcctgggatccaccacgcggcttcccccgttgctgccaacctctgcgacccggcgagacacgcacagcacacacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcg

SEQ ID NO: 263 - protein, 22 aa, Homo sapiens
FARKMLEKVHRQHLQLSHNSQE

SEQ ID NO: 264 - DNA, 66 bp, Homo sapiens
tttgctagaaaaatgctggagaaggtacacagacaacacctacagctttcccacaatagccaggaa

SEQ ID NO: 265 - protein, 11 aa, Homo sapiens
KRSFAVTERII

SEQ ID NO: 266 - DNA, 33 bp, Homo sapiens
aagagaagttttgctgtcacggagaggatcatc

SEQ ID NO: 267 - protein, 17 aa, Homo sapiens
MFLRKEQQVGPHSFSML

SEQ ID NO: 268 - DNA, 51 bp, Homo sapiens
atgttccttagaaaggagcagcaggtgggtccccacagcttttctatgctt

SEQ ID NO: 269 - protein, 14 aa, Homo sapiens
VLRFLDLKVRYLHS

SEQ ID NO: 270 - DNA, 42 bp, Homo sapiens
gtgctgcgctttctggacttaaaggtgagatacctgcactct

SEQ ID NO: 271 - protein, 32 aa, Homo sapiens
GNTTLQQLGEASQAPSGSLIPLRLPLLWEVRG

SEQ ID NO: 272 - DNA, 96 bp, Homo sapiens
ggcaacaccaccctccagcagctgggtgaggcctcccaggcgccctcaggctccctcatccctctgaggctgcctctgctctgggaagtgaggggc

SEQ ID NO: 273 - protein, 25 aa, Homo sapiens
GLNLNTDRPGGYSYSIWWKNNAKNR

SEQ ID NO: 274 - DNA, 75 bp, Homo sapiens
ggactgaacttaaatactgatagaccaggtggttacagctattcaatttggtggaaaaacaatgccaagaacaga

SEQ ID NO: 275 - protein, 27 aa, Homo sapiens
WKFEMSYTVGGPPPHVHARPRHWKTDR

SEQ ID NO: 276 - DNA, 81 bp, Homo sapiens
tggaaattcgagatgagctacacggtgggtggcccgcctccccatgttcatgctagacccaggcattggaaaactgataga

SEQ ID NO: 277 - protein, 22 aa, Homo sapiens
QWQHYHRSGEAAGTPLWRPTRN

SEQ ID NO: 278 - DNA, 66 bp, Homo sapiens
cagtggcagcactaccaccggtcaggtgaggccgcagggactcccctctggagacccacaagaaac

SEQ ID NO: 279 - protein, 29 aa, Homo sapiens
KVLNEIDAVVTVPPSLSTSQIPQGCCIIL

SEQ ID NO: 280 - DNA, 87 bp, Homo sapiens
aaggtcctcaacgagatcgatgcggtagttaccgtccctccctccctgtctacctcccagataccgcagggctgctgcatcatattg

SEQ ID NO: 281 - protein, 18 aa, Homo sapiens
ANLKGTLQVRSGQAVSPR

SEQ ID NO: 282 - DNA, 54 bp, Homo sapiens
gccaatctgaaaggcaccctgcaggtgaggagtgggcaggcagtgagtccacgc

SEQ ID NO: 283 - protein, 70 aa, Homo sapiens
LQAAASGQGKQGVPCPWGCCAYAESPRALISGDAPSQVEREVPGPCLNTHSLSHRSPQLPGLPHPKQPSV

SEQ ID NO: 284 - DNA, 210 bp, Homo sapiens
ctccaggcggctgcctcgggccaaggcaagcagggcgtcccttgtccctggggttgctgtgcctacgctgagagtccccgggccctgatttcgggagatgctccatcacaggtggagcgggaggtgccgggcccctgcctcaacacgcattctctctcccacagatccccacagctcccaggccttccacaccccaagcagccttctgtt

SEQ ID NO: 285 - protein, 9 aa, Homo sapiens
KIQNKNCPD

SEQ ID NO: 286 - DNA, 27 bp, Homo sapiens
aaaattcagaataaaaattgtccagac

SEQ ID NO: 287 - protein, 37 aa, Homo sapiens
GEVELSEGGEGQRHLAFPWACSGPGWRGVCCAAVEPA

SEQ ID NO: 288 - DNA, 111 bp, Homo sapiens
ggcgaggtggagctctcagagggcggtgagggccagcggcaccttgcatttccctgggcctgctctgggccgggctggagaggggtgtgctgtgctgctgtggagcctgct

SEQ ID NO: 289 - protein, 9 aa, Homo sapiens
IEMKKLLKS

SEQ ID NO: 290 - DNA, 27 bp, Homo sapiens
attgaaatgaaaaaactgttaaaaagt

SEQ ID NO: 291 - protein, 70 aa, Homo sapiens
KMRAIQAEGGHGQACCGGAWGWAPGDGGPQGMLTHTLPTLGFQSAWTWRREDADRAWRTPKACASRRWSI

SEQ ID NO: 292 - DNA, 210 bp, Homo sapiens
aagatgcgggccatccaggccgagggtgggcacgggcaggcctgctgtggaggggcctggggatgggcaccgggggacgggggcccccaggggatgctcacgcatactctgcccaccctgggcttccagagcgcctggacatggagaagagaagatgcagacagagcctggaggactccgaaagcctgcgcatcaaggaggtggagcata

SEQ ID NO: 293 - protein, 74 aa, Homo sapiens
LLEPFRRGEPGPRGLLSGSSRGGEGPGRSIEAAPATPLPCCRKNPCRPQPSRFLPPRVLLVIILPKLDCPKLGF

SEQ ID NO: 294 - DNA, 222 bp, Homo sapiens
ctgctggagcccttccgccgcggtgagcccgggccccgcgggctgctctcgggaagttcccgcggaggggaggggcctggccgttcgatcgaggctgcacccgccacacctttgccctgttgccgcaagaacccttgtcggccccagccttccagatttttgcctcctagggtattgttagtgatcattcttcccaaactggattgtccaaaacttgggttc

SEQ ID NO: 295 - protein, 65 aa, Homo sapiens
PSGRRTKRLVTLRSGCAIQCWHPRAGPVPSALPHTERPPRLVRGAADPRTVTLGRSPAVMPRAPA

SEQ ID NO: 296 - DNA, 195 bp, Homo sapiens
ccctcggggcggagaaccaaacggttagttaccctgcgttctggctgcgccatacaatgctggcatcctcgtgccggcccagttccctcagcgcttcctcacacagagaggcccccaaggcttgtcaggggagcagcagatcccaggacagtgaccctgggacggagccctgcagtcatgcctcgggcccctgcg

SEQ ID NO: 297 - protein, 95 aa, Homo sapiens
CHLFLQPQVGTPPPHTASARAPSGPPHPHESCPAGRRPARAAQTCARRQHGLPGCEEAGTARVPSLHLHLHQAALGAGRGRGWGEACAQVPPSRG

SEQ ID NO: 298 - DNA, 285 bp, Homo sapiens
tgccacctcttcctgcagccccaggttggcaccccccccccccacactgccagtgctcgagcccccagtggtccaccccaccctcatgaaagttgccctgcagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggc

SEQ ID NO: 299 - protein, 45 aa, Homo sapiens
KELKLEQQVGGQGLRGVGQGVRGGFVTLTTHTPFPSQEAAERESK

SEQ ID NO: 300 - DNA, 135 bp, Homo sapiens
aaggagctcaagctggagcagcaggtgggtgggcagggcttgagaggggtgggccaaggggtgcgtggcggcttcgtgaccctcactacccataccccgttcccctcccaggaagctgcagagcgggagtctaaa

SEQ ID NO: 301 - protein, 175 aa, Homo sapiens
GEISQEEVPPSRHLGVSWGAGVWAGLTLGASAPPNSSFPSGAELQPVVCCIRSDTRQPRPPDFPQHRGDPRLPQLSLGAENQTVSYPAFWLRHTMLASSCRPSSLSASSHREAPKACQGSSRSQDSDPGTEPCSHASGPCVTSTVSSPGLLPQRLLPLALTGLPVEEDGFEHAGA

SEQ ID NO: 302 - DNA, 525 bp, Homo sapiens
ggagaaatcagccaggaagaggtgcctccctcccgccacctgggcgtctcatggggtgctggggtgtgggcgggcctcaccctcggggcctctgcaccccctaactctagcttcccctcaggtgctgagctacagccagttgtgtgctgcattaggagtgacacaagacagccccgaccccccgactttcctcagcacaggggagatccacgccttcctcagctctccctcggggcggagaaccaaacggttagttaccctgcgttctggctgcgccatacaatgctggcatcctcgtgccggcccagttccctcagcgcttcctcacacagagaggcccccaaggcttgtcaggggagcagcagatcccaggacagtgaccctgggacggagccctgcagtcatgcctcgggcccctgcgtaacctccactgtctccagcccaggtctccttcctcagaggctattgcctctcgctctgactgggctccctgtggaggaagatggtttcgagcacgcgggagcc

SEQ ID NO: 303 - protein, 56 aa, Homo sapiens
DCMLSEEGGQARRGGSLCSLAAHTIASAARGRFLSRLSNFCAVVKASRGAPSCTWE

SEQ ID NO: 304 - DNA, 168 bp, Homo sapiens
gactgcatgctcagcgaggaaggtgggcaggcgcggcggggtggatccctctgctccttagctgcccacaccattgcctcggcagcccgaggtcgcttcctctccaggctctccaatttctgtgccgtagttaaagcgagcaggggcgccccttcctgcacctgggag

SEQ ID NO: 305 - protein, 43 aa, Homo sapiens
EAFQRAAGEGGPGRGGARRGARVLQSPFCRAGAGEWLGHQSLR

SEQ ID NO: 306 - DNA, 129 bp, Homo sapiens
gaggccttccagagggccgctggtgagggcggcccgggccgcggtggggcacggcgcggtgccagggtgttgcagagccccttttgcagggcaggagctggggagtggttaggacatcagtccctcagg

SEQ ID NO: 307 - protein, 35 aa, Homo sapiens
PEPRRLSPGEPRGRPRKGWGIWGLCGARVGPKAWR

SEQ ID NO: 308 - DNA, 105 bp, Homo sapiens
cctgagcccaggagactgagcccaggtgagcccagggggcgaccccggaagggctgggggatctggggtttgtgtggagcgcgggtggggcccaaggcttggcgg

SEQ ID NO: 309 - protein, 61 aa, Homo sapiens
VPFRELKNVSVLEGLRQGRLGGPCSCHCPRPSQARLTPVDVAGPFLCLGDPGLFPPVKSSI

SEQ ID NO: 310 - DNA, 183 bp, Homo sapiens
gtgcccttccgggagctcaagaacgtgagtgtcctggaggggctccgtcaaggccggcttgggggtccctgttcatgtcactgcccaagaccttcccaggccaggctcacgccagtggatgtggcaggtcccttcttgtgtctgggggatcctgggctgttccccccagtcaagagcagtatc

SEQ ID NO: 311 - protein, 98 aa, Homo sapiens
FVSLTAIQMASSATPWGRWPVATPTAACPRRRPSSLPTGGDSASKKPISRRAPWQPWACPGRSVNSAAPRAWCPPATTPRTQSPSRDLRPRCLSSWSS

SEQ ID NO: 312 - DNA, 294 bp, Homo sapiens
tttgtgagcctgactgccatccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagc

SEQ ID NO: 313 - protein, 109 aa, Homo sapiens
PVAIKPGTGPPNNSSIHGGSKRSENSYCRDLRGQLRAICCSSYSHDRHTTEERGSRGRHVWRIRRLHTSGLPCCCHSGPHPRRLPDILRLVTSTKTDHTNTTEGTLDYL

SEQ ID NO: 314 - DNA, 327 bp, Homo sapiens
ccagttgccattaaacctggtacagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactattta

SEQ ID NO: 315 - protein, 40 aa, Homo sapiens
KWNKNWTATLGALTIRGHKLLCHLPHLLSSVQQTCRSSSR

SEQ ID NO: 316 - DNA, 120 bp, Homo sapiens
aagtggaacaagaactggacagccacactcggggctcttacaatcaggggtcataagctgctatgtcacctacctcaccttctcagctctgtccagcaaacctgcagaagtagttctaga

SEQ ID NO: 317 - protein, 50 aa, Homo sapiens
FKKFDGPCGERGGGRTARALWARGDSVLTPALDPQTPVRAPSLTRAAAAV

SEQ ID NO: 318 - DNA, 150 bp, Homo sapiens
ttcaagaagttcgacggcccttgtggtgagcgcggcggcgggcgcacggctcgagctctgtgggcgcgcggcgacagcgtcctgactcctgccctcgacccccagacccctgtcagggcgccctccctgacccgagccgcagctgccgtg

SEQ ID NO: 319 - protein, 52 aa, Homo sapiens
ENASLVFTGSNSPIPACELSSHPAHGISPWIPSPGNEHFHGIKKQVKAIKVE

SEQ ID NO: 320 - DNA, 156 bp, Homo sapiens
gaaaatgccagcctagtgtttacaggatccaacagccccataccagcctgcgaactgagtagtcacccagctcatggtatcagtccttggataccctcacctggaaatgaacatttccatggcataaagaagcaagtaaaggcaataaaagtagaa

SEQ ID NO: 321 - protein, 55 aa, Homo sapiens
RLTQRLVQGWTPMENRWCGRRAGGQPASSSTRWTTCRAACLLTKWTAGRSQTSIG

SEQ ID NO: 322 - DNA, 165 bp, Homo sapiens
cggctgacgcaacggctggtccagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattgga

SEQ ID NO: 323 - protein, 32 aa, Homo sapiens
ENSGNASRWLHVPSSSDDWLGWKKSSAITSNS

SEQ ID NO: 324 - DNA, 96 bp, Homo sapiens
gaaaattcaggcaacgcctcgcgttggctgcatgtaccaagtagttcagacgattggctcggatggaaaaaatcttctgcaattacttccaattcc

SEQ ID NO: 325 - protein, 59 aa, Homo sapiens
GMECTLGQVGAPSPRREEDGWRGGHSRFKADVPAPQGPCWGGQPGSAPSSAPPEQSLLD

SEQ ID NO: 326 - DNA, 177 bp, Homo sapiens
ggcatggagtgcaccctggggcaggtgggtgccccgtcccctcggagggaggaggacggttggcgtgggggccacagccgattcaaggctgatgtaccagcaccgcagggaccctgctggggtggccaacctggctctgccccctcctcagctcctcctgaacagtcattattagat

SEQ ID NO: 327 - protein, 110 aa, Homo sapiens
KGSVERRSVSLGHPAEGWAWAERSLQPGMTTANTGCLSFHHRGCLLPVLPKLHCGLGGLPLVRAKEIKRVQRAGESSLPVKGLLTVASAVIAVLWGRPSEVTGENEAQHD

SEQ ID NO: 328 - DNA, 330 bp, Homo sapiens
aaagggagtgtggagaggcgctcggtgagcctggggcatcctgctgagggttgggcatgggcagagaggagcctccagccaggcatgaccacagccaacacaggctgcctctcattccaccacagagggtgcctcctccctgttttgcccaaattacactgtgggctaggtggactacctcttgtcagagctaaagaaatcaagcgagtgcagagggcaggggagagttcgctgcctgtgaagggccttctcaccgtcgcttcggctgtcatcgcagtcctgtggggtaggccaagcgaggtcacaggagaaaatgaggctcagcatgat

SEQ ID NO: 329 - protein, 75 aa, Homo sapiens
FGLTTLAGRSSHGTSGLRAATHTKSGDGGQGAARQCEKLLELARATRPWGRSTSASSRWTHRGYMCPPRCAVACW

SEQ ID NO: 330 - DNA, 225 bp, Homo sapiens
tttggcctcaccacacttgcaggtagaagctcccacgggacctcaggactgagggcagccacacacaccaagtctggggacggtggccagggggctgccaggcagtgtgagaagctcctggagctggcccgggctaccagaccctgggggaggagtacgtcagcatcatccaggtggacccatcgcggatacatgtgccctcctcgctgcgccgtggcgtgctgg

SEQ ID NO: 331 - protein, 29 aa, Homo sapiens
IIDSDKIMAVCMGCLLTRHVQCQAMEMQQ

SEQ ID NO: 332 - DNA, 87 bp, Homo sapiens
attattgacagcgacaagataatggcagtgtgcatggggtgcctgctcacacgtcatgtgcaatgccaggccatggagatgcaacag

SEQ ID NO: 333 - protein, 49 aa, Homo sapiens
DGHSYTSKVNCLLLQDGFHGCVSITGAAGRRNLSIFLFLMLCKLEFHAC

SEQ ID NO: 334 - DNA, 147 bp, Homo sapiens
gatggccactcctacacatccaaggtgaattgtttactccttcaagatgggttccatggctgtgtgagcatcaccggggcagctggaagaagaaacctgagcatcttcctgttcttgatgctgtgcaaattggagttccatgcttgt

SEQ ID NO: 335 - protein, 70 aa, Homo sapiens
LLNAEDYRCAIHSKEIYLLSPSPHQAMDKFSLCCINCNLCLHVFLLLLFFQNKDVWLISNIILLWIYGGI

SEQ ID NO: 336 - DNA, 210 bp, Homo sapiens
ctactaaatgcagaagattaccggtgtgccattcattcaaaagagatttatcttctttccccctccccccaccaggcaatggacaagttttctctctgctgcatcaactgcaatctatgtttacatgtattccttttactactattttttcaaaacaaagatgtatggcttatttcaaacatcattttactttggatatatggcggtatt

SEQ ID NO: 337 - protein, 33 aa, Homo sapiens
TGGKSTCSAPGPQSLPSTPFSTYPQWVILITEL

SEQ ID NO: 338 - DNA, 99 bp, Homo sapiens
acagggggcaaaagcacctgctcggctcctggccctcagtctctcccctccactccattctccacctacccacagtgggtcattctgatcaccgaactg

SEQ ID NO: 339 - protein, 28 aa, Homo sapiens
VETLENANSFSSGIQPLLCSLIGLENPT

SEQ ID NO: 340 - DNA, 84 bp, Homo sapiens
gtggagaccctggagaatgccaacagcttctccagcgggatccagccactcctctgttccctgattggcctggagaatcccacc

SEQ ID NO: 341 - protein, 38 aa, Homo sapiens
AGAGTISEGSVLHGQRLECDARRFFGCGTTILAEWEHH

SEQ ID NO: 342 - DNA, 114 bp, Homo sapiens
gctggggctggaacaatttccgaaggtagtgttctccatggtcagaggctggagtgtgatgccagacgtttttttgggtgtgggactacaatactggcagagtgggagcaccat

SEQ ID NO: 343 - protein, 17 aa, Homo sapiens
GVPGDSTRRAVRRMNTF

SEQ ID NO: 344 - DNA, 51 bp, Homo sapiens
ggagttccaggagattcaaccaggagagcagtgaggagaatgaataccttc

SEQ ID NO: 345 - protein, 20 aa, Homo sapiens
HVVGYGHLDTSGSSSSSSWP

SEQ ID NO: 346 - DNA, 60 bp, Homo sapiens
cacgtggtgggctatggccaccttgatacttccgggtcatcctcctcctcctcctggccc

SEQ ID NO: 347 - protein, 64 aa, Homo sapiens
WTPIPVLTRWPLPHPPPWRRATSCRMARSSPSATSGSSVRRRCSSLPSWVWNLAASTRPRSTPS

SEQ ID NO: 348 - DNA, 196 bp, Homo sapiens
tggacgcccatcccggtgctcacgagatggccactaccacatcctcctccctggagaagagctacaagctgccggatggccaggtcatcaccatcagcaacaagcggttccagtgtccggaggcgctgttccagccttccttcctgggtatggaatcttgcggcatccacgagaccacgttcaactccatcatgaa

SEQ ID NO: 349 - protein, 16 aa, Homo sapiens
SLYHREKQLIAMDSAI

SEQ ID NO: 350 - DNA, 48 bp, Homo sapiens
tccctctaccaccgggagaagcagctcattgctatggacagtgctatc

SEQ ID NO: 351 - protein, 43 aa, Homo sapiens
LHPQRETFTPRWSGANYWKLAFPVGAEGTFPAAATQRGVVRPA

SEQ ID NO: 352 - DNA, 131 bp, Homo sapiens
cttcatcctcagagggaaacattcactccccggtggtcgggcgcgaattactggaaattggcttttcccgttggggccgaaggtaccttccctgcggcggcgactcagcggggtgtcgttcggccggcgtg

SEQ ID NO: 353 - protein, 35 aa, Homo sapiens
NSKMALNSLNSIDDAQLTRIAPPRSHCCFWEVNAP

SEQ ID NO: 354 - DNA, 105 bp, Homo sapiens
aacagcaagatggctttgaactcattaaactccattgatgatgcacagttgacaagaattgcccctccaagatctcattgctgtttctgggaagtaaacgctcct

SEQ ID NO: 355 - protein, 50 aa, Homo sapiens
MAGGVLRRLLCREPDRDGDKGASREETVVPLHIGDPVVLPGIGQCYSALF

SEQ ID NO: 356 - DNA, 151 bp, Homo sapiens
atggctggaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttct

SEQ ID NO: 357 - protein, 39 aa, Homo sapiens
DDRNTFDIVWWCPMSRLRLALTVPPSTTTTCVTVPAWAA

SEQ ID NO: 358 - DNA, 120 bp, Homo sapiens
gatgacagaaacactttcgacatagtgtggtggtgccctatgagccgcctgaggttggctctgactgtaccaccatccactacaactacatgtgtaacagttcctgcatgggcggcatga

SEQ ID NO: 359 - protein, 17 aa, Homo sapiens
VQPIARELYQFTFDLLI

SEQ ID NO: 360 - DNA, 51 bp, Homo sapiens
gtgcagcctattgcgagagagctgcatcagttcacttttgacctgctaatc

SEQ ID NO: 361 - protein, 17 aa, Homo sapiens
QMAVIQYSCMGLMVFAM

SEQ ID NO: 362 - DNA, 51 bp, Homo sapiens
cagatggctgtcattcagtactcctgcatggggctcatggtgtttgccatg

SEQ ID NO: 363 - protein, 17 aa, Homo sapiens
PKSEVRAKCKFSILNAK

SEQ ID NO: 364 - DNA, 50 bp, Homo sapiens
caaagagtgaagttcgggcaaaattcaaatgctccatcctgaatgccaag

SEQ ID NO: 365 - protein, 17 aa, Homo sapiens
MMAEIISVHVPKILSGK

SEQ ID NO: 366 - DNA, 51 bp, Homo sapiens
atgatggcagagatcatctctgtgcacgtgcccaagatcctttctgggaaa

SEQ ID NO: 367 - protein, 17 aa, Homo sapiens
LHPDSGNMVENGCYLRR

SEQ ID NO: 368 - DNA, 51 bp, Homo sapiens
ctgcacccggactccggcaacatggtcgagaacggctgctacttgcgccgc

SEQ ID NO: 369 - protein, 17 aa, Homo sapiens
CYLRRQKRLKCEKQPGA

SEQ ID NO: 370 - DNA, 51 bp, Homo sapiens
tgctacttgcgccgccagaagcgcttgaagtgcgagaagcagccgggggcc

SEQ ID NO: 371 - protein, 17 aa, Homo sapiens
MFENGCYLGRQKRFKCE

SEQ ID NO: 372 - DNA, 51 bp, Homo sapiens
atgttcgagaacggctgctacttgggccgccagaagcgcttcaagtgcgag

SEQ ID NO: 373 - protein, 16 aa, Homo sapiens
DSSGNLLERNSFEVRV

SEQ ID NO: 374 - DNA, 48 bp, Homo sapiens
gactccagtggtaatctactggaacggaacagctttgaggtgcgtgtt

SEQ ID NO: 375 - protein, 61 aa, Homo sapiens
VFFKRAAEGFFRMNKLKESSDTNPKPYCMAAPMGLTENNRNRKKSYRETNLKAVSWPLNHT

SEQ ID NO: 376 - DNA, 183 bp, Homo sapiens
gtcttcttcaaaagagccgctgaaggatttttcagaatgaacaaattaaaagaatcatcagacactaaccccaagccatactgcatggcagcaccaatgggactgacagaaaacaacagaaataggaagaaatcctacagagaaacaaacttgaaagctgtctcatggcctttgaatcatact

SEQ ID NO: 377 - protein, 15 aa, Homo sapiens
LTFLDFIQVTLRVMS

SEQ ID NO: 378 - protein, 15 aa, Homo sapiens
VTLRVMSGSQMENGS

SEQ ID NO: 379 - protein, 24 aa, Homo sapiens
YEAGMTLGEKFRVGNCKHLKMTRP

SEQ ID NO: 380 - DNA, 72 bp, Homo sapiens
tatgaagcagggatgactctgggagaaaaattccgggttggcaattgcaagcatctcaaaatgaccagaccc

SEQ ID NO: 381 - protein, 28 aa, Homo sapiens
YEAGMTLGGKILFFLFLLLPLSPFSLIF

SEQ ID NO: 382 - DNA, 84 bp, Homo sapiens
tatgaagcagggatgactctgggaggtaagatacttttctttctcttcctcctccttcctctctcccccttctccctcattttc

SEQ ID NO: 383 - protein, 16 aa, Homo sapiens
GYLRMQGLMAQRLLLR

SEQ ID NO: 384 - DNA, 48 bp, Homo sapiens
gggtacctgaggatgcagggactcatggctcagcgacttcttctgagg

SEQ ID NO: 385 - protein, 48 aa, Homo sapiens
DGHSYTSKVNCLLLQDGFHGCVSITGAAGRRNLSIFLFLMLCKLEFHA

SEQ ID NO: 386 - DNA, 144 bp, Homo sapiens
gatggccactcctacacatccaaggtgaattgtttactccttcaagatgggttccatggctgtgtgagcatcaccggggcagctggaagaagaaacctgagcatcttcctgttcttgatgctgtgcaaattggagttccatgct

SEQ ID NO: 387 - protein, 9 aa, Homo sapiens
STRRAVRRM

SEQ ID NO: 388 - protein, 9 aa, Homo sapiens
RAVRRMNTF

SEQ ID NO: 389 - protein, 9 aa, Homo sapiens
IPVLTRWPL

SEQ ID NO: 390 - protein, 9 aa, Homo sapiens
QLIAMDSAI

SEQ ID NO: 391 - protein, 9 aa, Homo sapiens
FPVGAEGTF

SEQ ID NO: 392 - protein, 9 aa, Homo sapiens
NSKMALNSL

SEQ ID NO: 393 - protein, 9 aa, Homo sapiens
GVLRRLLCR

SEQ ID NO: 394 - protein, 9 aa, Homo sapiens
CPMSRLRLA

SEQ ID NO: 395 - protein, 9 aa, Homo sapiens
YQFTFDLLI

SEQ ID NO: 396 - protein, 9 aa, Homo sapiens
IQYSCMGLM

SEQ ID NO: 397 - protein, 9 aa, Homo sapiens
RAKCKFSIL

SEQ ID NO: 398 - protein, 9 aa, Homo sapiens
HVPKILSGK

SEQ ID NO: 399 - protein, 9 aa, Homo sapiens
NMVENGCYL

SEQ ID NO: 400 - protein, 9 aa, Homo sapiens
YLRRQKRLK

SEQ ID NO: 401 - protein, 9 aa, Homo sapiens
CYLGRQKRF

SEQ ID NO: 402 - protein, 9 aa, Homo sapiens
LLERNSFEV

SEQ ID NO: 403 - protein, 9 aa, Homo sapiens
YCMAAPMGL

SEQ ID NO: 404 - protein, 9 aa, Homo sapiens
FFKRAAEGF

SEQ ID NO: 405 - protein, 9 aa, Homo sapiens
RVGNCKHLK

SEQ ID NO: 406 - protein, 9 aa, Homo sapiens
FLFLLLPLS

SEQ ID NO: 407 - protein, 9 aa, Homo sapiens
LMAQRLLLR

SEQ ID NO: 408 - protein, 9 aa, Homo sapiens
IVWWCPMSR

SEQ ID NO: 409 - protein, 9 aa, Homo sapiens
CTELKLSDY

SEQ ID NO: 410 - protein, 9 aa, Homo sapiens
NLVPMVATV

SEQ ID NO: 411 - protein, 9 aa, Homo sapiens
LIYRRRLMK

SEQ ID NO: 412 - protein, 9 aa, Homo sapiens
LYSACFWWL

SEQ ID NO: 413 - protein, 9 aa, Homo sapiens
NPKASLLSL

SEQ ID NO: 414 - protein, 9 aa, Homo sapiens
ELRSRYWAI

SEQ ID NO: 415 - protein, 15 aa, Homo sapiens
SQMENGSSYFFKPFS

SEQ ID NO: 416 - protein, 9 aa, Homo sapiens
IVTDFSVIK

SEQ ID NO: 417 - protein, 15 aa, Homo sapiens
YFFKPFSWGLGVGLS

SEQ ID NO: 418 - protein, 15 aa, Homo sapiens
FMIGELVGELCCQLT

SEQ ID NO: 419 - protein, 15 aa, Homo sapiens
ELCCQLTFRLPFLES

SEQ ID NO: 420 - protein, 15 aa, Homo sapiens
RLPFLESLCQAVVTQ

SEQ ID NO: 421 - protein, 9 aa, Homo sapiens
KLSRALRYY

SEQ ID NO: 422 - protein, 9 aa, Homo sapiens
MVFELANSI

SEQ ID NO: 423 - protein, 9 aa, Homo sapiens
ILFQNIDGK

SEQ ID NO: 424 - protein, 9 aa, Homo sapiens
KIVIARYGK

SEQ ID NO: 425 - protein, 9 aa, Homo sapiens
FLLELLSDS

SEQ ID NO: 426 - protein, 10 aa, Homo sapiens
VTFLKPCFLL

SEQ ID NO: 427 - protein, 8 aa, Homo sapiens
TDIVKQSV

SEQ ID NO: 428 - protein, 10 aa, Homo sapiens
SPAFPKPVRP

SEQ ID NO: 429 - protein, 12 aa, Homo sapiens
SYFSLTNIFNFV

SEQ ID NO: 430 - protein, 12 aa, Homo sapiens
EFSPETCAFRLS

SEQ ID NO: 431 - protein, 9 aa, Homo sapiens
FLSRALRAL

SEQ ID NO: 432 - protein, 8 aa, Homo sapiens
KKDLELIL

SEQ ID NO: 433 - protein, 8 aa, Homo sapiens
KLQKNCLL

SEQ ID NO: 434 - protein, 9 aa, Homo sapiens
SALSGNSWV

SEQ ID NO: 435 - protein, 7 aa, Homo sapiens
TVRAILL

SEQ ID NO: 436 - protein, 10 aa, Homo sapiens
GSLHFHEVLK

SEQ ID NO: 437 - protein, 75 aa, Homo sapiens
HYKLIQQPISLFSITDRLHKTFSQLPSVHLCSITFQWGHPPIFCSTNDICVTANFCISVTFLKPCFLLHEASASQ

SEQ ID NO: 438 - protein, 40 aa, Homo sapiens
WTDIVKQSVSTNCISIKKGSYTKLFSLVFLIFCWPLIIQL

SEQ ID NO: 439 - protein, 144 aa, Homo sapiens
RTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLG

SEQ ID NO: 440 - protein, 36 aa, Homo sapiens
LRYGALCNVSRISYFSLTNIFNFVIKSLTAIFTVKF

SEQ ID NO: 441 - protein, 295 aa, Homo sapiens
RKERNIRKSESTLRLSPFPTPAPSGAPAAAQGKVVRVPGPAGGLVPRDAGARLLPPAGGPGGGAAAGEGRAGRGRFPSITEPRPRDLPPRVATGRRAGGRRKGAGQGVRTRPLPASWPGGRGPFRKGPRRLPLGSGPPAAGVQRLRCSHLSRGPRRRRGRVCGRACVSPPLPPRPPPVGLSAENLSWLSSGLPRACSWREFSPETCAFRLSGLDSKLSARVERDLGALRAPGSRAAQGGGRVRGSRSEWKTRPWRPPPAWPLTRAGGPLPKNPFLESCSETAQRRRVFSFSTPLS

SEQ ID NO: 442 - protein, 67 aa, Homo sapiens
YAYKDFLWCFPFSLVFLQEIQICCHVSCLCCICCSTRICLGCLLELFLSRALRALHVLWNGFQLHCQ

SEQ ID NO: 443 - protein, 82 aa, Homo sapiens
SINKATITGKKDLELILHVSRKKPFLPRVNITPTPISCCNLKMLKKFFLLYIIISIIDLTNCLSCYLEHFYRFTFFTDVHYF

SEQ ID NO: 444 - protein, 16 aa, Homo sapiens
TMPAILKLQKNCLLSL

SEQ ID NO: 445 - protein, 84 aa, Homo sapiens
PYYSALSGNSWVPSTLESDPFGYVFSPLATRPALNDQESILWPTLTSVVSCALSCPSLNLPENWLTLITGGMKGGKKMKFTFRH

SEQ ID NO: 446 - protein, 46 aa, Homo sapiens
GLRNLGNTVRAILLSFLSKRNVKWCWGWGKPTSLGKACGRRALKLF

SEQ ID NO: 447 - protein, 22 aa, Homo sapiens
MEAENAGSLHFHEVLKMGHVKF

SEQ ID NO: 448 - DNA, 225 bp, Homo sapiens
cactacaaattaattcaacaacccatatccctcttctccatcactgataggctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacag

SEQ ID NO: 449 - DNA, 120 bp, Homo sapiens
tggactgatatagttaagcagtctgtaagtacaaactgcatttctatcaagaaaggtagctatacaaaactgttttccttagtctttcttattttctgttggccattaattattcagttg

SEQ ID NO: 450 - DNA, 432 bp, Homo sapiens
aggaccgccctgacacacaatcaggacttctctatctacaggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggc

SEQ ID NO: 451 - DNA, 108 bp, Homo sapiens
cttcgctatggtgccttatgcaatgtaagtagaataagttatttcagtctaacaaatatatttaattttgtaattaaatcactaactgctatttttactgtgaaattt

SEQ ID NO: 452 - DNA, 885 bp, Homo sapiens
cgaaaagagagaaacatccgaaaaagtgagtccacgctgcgcctgtccccgttccccacccccgccccgtcgggggcgcccgcggccgcgcaggggaaagttgtccgggtccccgggccggcgggcgggctggtcccccgggacgctggcgctcggctcctgcccccggcgggcggcccggggggaggggcggcggcgggggaggggcgcgcgggccgcggccggttccctagcatcacggagcctcgaccccgcgacctcccgccccgggtcgccaccggccggcgggcgggaggccggcggaaaggcgccgggcagggcgtgcgcacccgtcccttgcccgcgagctggcccgggggtcgcggccctttccggaaggggccccggcgtctgccgctgggctccggcccgcccgctgcgggagtgcagcggctgcgttgctcccacctgagccgcgggccgaggaggcggaggggccgagtgtgcgggagggcgtgtgtctcgcctccccttcctccccggcccccgcctgtcggcctttctgctgagaacctaagctggttgtcaagtggtttgcctcgggcgtgttcctggcgcgagttcagccccgagacctgtgcgtttcggctctcgggtttggattcgaaactttccgctcgggttgagcgtgacttgggtgcgctgcgggcgccggggtcgcgggctgcgcagggcggtgggcgtgtgcgcgggagccggtcggagtggaaaacgcgcccgtggcggccacctccagcctggccgctcacccgagcaggggggccgctgcccaagaaccctttcctggagagctgctccgagaccgcacagcgccgccgcgtcttctccttttccactcctctctcc

SEQ ID NO: 453 - DNA, 201 bp, Homo sapiens
tatgcttacaaggactttctctggtgttttcctttttctttagtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaa

SEQ ID NO: 454 - DNA, 246 bp, Homo sapiens
tccatcaacaaagccaccataacaggtaagaaagatctggagcttattcttcatgtgtctaggaagaaaccatttctgccaagagtcaatataacaccaacaccaatttcatgctgcaatttgaaaatgttaaagaaattctttcttctctacattatcatttctatcattgatctcacaaattgtctaagctgttatttggaacatttttaccgatttacgttttttactgatgtacattatttt

SEQ ID NO: 455 - DNA, 48 bp, Homo sapiens
accatgcctgctattttaaagttacagaagaattgtcttctctcctta

SEQ ID NO: 456 - DNA, 252 bp, Homo sapiens
ccatactacagcgcactgtcaggtaacagctgggttcccagcaccctggaaagtgacccgtttggctatgtttttagccccttagcaacacggccagctctcaatgaccaagagtccatcttgtggccgaccctgacttctgtggtttcctgtgctctatcctgcccatctcttaacttacctgagaattggctcactctcatcacaggtggaatgaaagggggaaaaaaaatgaaattcacattcagacac

SEQ ID NO: 457 - DNA, 138 bp, Homo sapiens
ggccttcgaaacctgggaaacacggtgagagctattctcctatctttcctctctaaaaggaatgtgaaatggtgctgggggtggggaaaacccacgagcttggggaaggcatgtggaaggagagctctgaagctcttc

SEQ ID NO: 458 - DNA, 66 bp, Homo sapiens
atggaagcggagaacgcgggcagtttgcattttcatgaagtgctcaaaatgggacatgtgaaattc

SEQ ID NO: 459 - DNA, 81 bp, Artificial sequence
  Codon-optimized polynucleotide
tggaagttcgagatgagctacaccgtcggcggacctccacctcatgttcatgccagacctcggcactggaaaaccgacaga

SEQ ID NO: 460 - DNA, 84 bp, Artificial sequence
  Codon-optimized polynucleotide
tatgaggccggcatgacactcggcggcaagatcctgttcttcctgttcctgctgctccctctgagccccttcagcctgatcttc

SEQ ID NO: 461 - DNA, 147 bp, Artificial sequence
  Codon-optimized polynucleotide
gatggccacagctacaccagcaaagtgaactgcctcctgctgcaggatggcttccacggctgtgtgtctattactggcgccgctggcagacggaacctgagcatctttctgtttctgatgctgtgcaagctcgagttccacgcctgc

SEQ ID NO: 462 - DNA, 99 bp, Artificial sequence
  Codon-optimized polynucleotide
acaggcggcaagtccacatgttctgcccctggacctcagagcctgcctagcacacccttcagcacataccctcagtgggtcatcctgatcaccgaactc

SEQ ID NO: 463 - DNA, 42 bp, Artificial sequence
  Codon-optimized polynucleotide
gtgctgagattcctggacctgaaagtgcgctacctgcacagc

SEQ ID NO: 464 - DNA, 54 bp, Artificial sequence
  Codon-optimized polynucleotide
gactattgggctcaaaaagagaagggcagcagcagcttcctgcggcctagctgt

SEQ ID NO: 465 - DNA, 183 bp, Artificial sequence
  Codon-optimized polynucleotide
gtccccttcagagagctgaagaacgtttccgtgctggaaggcctgagacagggcagacttggcggcccttgtagctgtcactgccccagacctagtcaggccagactgacacctgtggatgtggccggacctttcctgtgtctgggagatcctggcctgtttccacctgtgaagtccagcatc

SEQ ID NO: 466 - DNA, 177 bp, Artificial sequence
  Codon-optimized polynucleotide
ggcatggaatgcaccctgggacaagtgggagccccatctcctagaagagaagaggatggctggcgcggaggccactctagattcaaagctgatgtgcccgctcctcagggcccttgttggggaggacaacctggatctgccccatcttctgccccacctgaacagtccctgctggat

SEQ ID NO: 467 - DNA, 96 bp, Artificial sequence
  Codon-optimized polynucleotide
ggcaacacaaccctccagcaactgggagaagcctctcaggctcctagcggctctctgatccctctcagactgcctctcctgtgggaagttcggggc

SEQ ID NO: 468 - DNA, 129 bp, Artificial sequence
  Codon-optimized polynucleotide
gaggctttccaaagagctgctggcgaaggcggacctggtagaggtggtgctagaagaggtgctagggtgctgcagagcccattctgtagagcaggcgcaggcgaatggctgggccatcagagtctgaga

SEQ ID NO: 469 - DNA, 51 bp, Artificial sequence
  Codon-optimized polynucleotide
gattattgggcccagaaagaaaagatcagcatccccagaacacacctgtgc

SEQ ID NO: 470 - DNA, 48 bp, Artificial sequence
  Codon-optimized polynucleotide
gtggccatgatggtgcccgatagacaggtccactacgactttggactg

SEQ ID NO: 471 - DNA, 270 bp, Artificial sequence
  Codon-optimized polynucleotide
gtgcccttccgggaactgaagaaccagagaacagctcagggcgctcctggaatccaccatgctgcttctccagtggccgccaacctgtgtgatcctgccagacatgcccagcacaccaggattccttgtggcgctggacaagtgcgcgctggaagaggacctgaagcaggcggaggtgttctgcaacctcaaagacccgctcctgagaagcctggctgcccttgcagaagaggacagcctagactgcacaccgtgaaaatgtggcgagcc

SEQ ID NO: 472 - DNA, 33 bp, Artificial sequence
  Codon-optimized polynucleotide
aagagaagctttgccgtgaccgagcggatcatc

SEQ ID NO: 473 - DNA, 150 bp, Artificial sequence
  Codon-optimized polynucleotide
ttcaagaagttcgacggcccttgcggagaaagaggcggaggcagaacagctagagccctttgggctagaggcgacagcgttctgacaccagctctggaccctcagacacctgttagggcccctagcctgacaagagctgccgccgctgtg

SEQ ID NO: 474 - DNA, 42 bp, Artificial sequence
  Codon-optimized polynucleotide
ctggtgctgggagtgctgtctggacactctggcagcagactg

SEQ ID NO: 475 - DNA, 66 bp, Artificial sequence
  Codon-optimized polynucleotide
cagtggcagcactatcacagatctggcgaagccgccggaacacccctttggaggccaacaagaaac

SEQ ID NO: 476 - DNA, 285 bp, Artificial sequence
  Codon-optimized polynucleotide
tgccacttgtttctgcagccccaagtgggcacacctcctccacatacagcctctgctagagcacctagcggccctccacatcctcacgaatcttgtcctgccggaagaaggcctgccagagccgctcaaacatgtgccagacgacagcacggactgcctggatgtgaagaggctggaacagccagagtgcctagcctgcacctccatctgcatcaggctgctcttggagccggaagaggtagaggatggggcgaagcttgtgctcaggtgccaccttctagaggc

SEQ ID NO: 477 - DNA, 27 bp, Artificial sequence
  Codon-optimized polynucleotide
aagatccagaacaagaactgccccgac

SEQ ID NO: 478 - DNA, 225 bp, Artificial sequence
  Codon-optimized polynucleotide
cactacaagctgatccagcagccaatcagcctgttcagcatcaccgaccggctgcacaagacattcagccagctgccaagcgtgcacctgtgctccatcaccttccagtggggacaccctcctatcttttgctccaccaacgacatctgcgtgaccgccaacttctgtatcagcgtgaccttcctgaagccttgctttctgctgcacgaggccagcgcctctcag

SEQ ID NO: 479 - DNA, 432 bp, Artificial sequence
  Codon-optimized polynucleotide
cgaaccgctctgacacacaaccaggacttcagcatctacagactgtgttgcaagcggggctccctgtgccatgcaagccaagctagaagccccgcctttcctaaacctgtgcgacctctgccagctccaatcaccagaattacccctcagctcggcggccagagcgattcatctcaacctctgctgaccaccggcagacctcaaggctggcaagaccaagctctgagacacacccagcaggctagccctgcctcttgtgccaccatcacaatccccatccactctgccgctctgggcgatcattctggcgatcctggaccagcctgggacacatgtcctccactgccactcacaacactgatccctagggctcctccaccttacggcgattctaccgctagaagctggcccagcagatgtggaccactcgga

SEQ ID NO: 480 - DNA, 201 bp, Artificial sequence
  Codon-optimized polynucleotide
tacgcctacaaggacttcctgtggtgcttccccttctctctggtgttcctgcaagagatccagatctgctgtcatgtgtcctgcctgtgctgcatctgctgtagcaccagaatctgcctgggctgtctgctggaactgttcctgagcagagccctgagagcactgcacgtgctgtggaacggattccagctgcactgccag

SEQ ID NO: 481 - DNA, 48 bp, Artificial sequence
  Codon-optimized polynucleotide
acaatgcccgccatcctgaagctgcagaagaattgcctcctaagcctg

SEQ ID NO: 482 - DNA, 72 bp, Artificial sequence
  Codon-optimized polynucleotide
tacgaagccgggatgaccctgggcgagaagttcagagtgggcaactgcaagcacctgaagatgacccggcct

SEQ ID NO: 483 - DNA, 51 bp, Artificial sequence
  Codon-optimized polynucleotide
ggcgtgccaggcgatagcactcggagagccgtcagacggatgaacaccttt

SEQ ID NO: 484 - DNA, 48 bp, Artificial sequence
  Codon-optimized polynucleotide
tgtggcgcctctgcctgtgacgtgtccctgatcgctatggactccgcc

SEQ ID NO: 485 - DNA, 48 bp, Artificial sequence
  Codon-optimized polynucleotide
agcctgtaccaccgggaaaagcagctcattgccatggacagcgccatc

SEQ ID NO: 486 - DNA, 48 bp, Artificial sequence
  Codon-optimized polynucleotide
accgagtacaaccagaaactgcaagtgaaccagttcagcgagagcaag

SEQ ID NO: 487 - DNA, 72 bp, Artificial sequence
  Codon-optimized polynucleotide
accgagatcagctgctgcaccctgagcagcgaggaaaacgagtacctgcctagacctgagtggcagctgcag

SEQ ID NO: 488 - DNA, 42 bp, Artificial sequence
  Codon-optimized polynucleotide
tgcgaagagagaggcgccgcaggatctctgatctcctgcgaa

SEQ ID NO: 489 - DNA, 48 bp, Artificial sequence
  Codon-optimized polynucleotide
aacagcaagatggccctgaatagcgaggccctgtctgtggtgtctgaa

SEQ ID NO: 490 - DNA, 210 bp, Artificial sequence
  Codon-optimized polynucleotide
tggggcatggaactggccgccagcagaagattcagctgggatcatcatagcgcaggcggcccacctagagtgccatctgttagaagcggagctgcccaggtgcagcctaaagatcctctgccactgagaacactggccggctgccttgctagaacagcccatcttagacctggcgccgagtctctgcctcagccacaactgcactgtacc

SEQ ID NO: 491 - DNA, 60 bp, Artificial sequence
  Codon-optimized polynucleotide
catgtcgtcggctacggccacctggatacaagcggaagcagctctagctccagctggcct

SEQ ID NO: 492 - DNA, 105 bp, Artificial sequence
  Codon-optimized polynucleotide
aactcaaaaatggctctgaacagcctgaactccatcgacgacgcccagctgacaagaatcgcccctcctagatctcactgctgcttttgggaagtgaacgcccca

SEQ ID NO: 493 - DNA, 48 bp, Artificial sequence
  Codon-optimized polynucleotide
aagatgcactttagcctgaaagaacaccctccaccaccttgtcctcca

SEQ ID NO: 494 - DNA, 207 bp, Artificial sequence
  Codon-optimized polynucleotide
ctgtggttccagtccagcgagctgtctcctactggtgccccttggccatctagacgccctacttggagaggcaccaccgtgtcaccaagaaccgccacaagcagcgccagaacctgttgtggcacaaagtggccctccagccaagaagccgctctcggacttggaagcggactgctgaggttctcttgtggaaccgccgccattcgg

SEQ ID NO: 495 - DNA, 51 bp, Artificial sequence
  Codon-optimized polynucleotide
atcgctagagagctgcaccagttcgccttcgacctgctgatcaagagccac

SEQ ID NO: 496 - DNA, 51 bp, Artificial sequence
  Codon-optimized polynucleotide
cagcctgattcttttgccgcactgcacagctccctgaacgagctgggagag

SEQ ID NO: 497 - DNA, 51 bp, Artificial sequence
  Codon-optimized polynucleotide
ttcgtgcaaggcaaggattggggcctcaaaaagtttatccgcagagacttc

SEQ ID NO: 498 - DNA, 51 bp, Artificial sequence
  Codon-optimized polynucleotide
tttgtgcagggcaaagactggggcgtgaagaagttcatccggcgggacttc

SEQ ID NO: 499 - DNA, 204 bp, Artificial sequence
  Codon-optimized polynucleotide
cagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgccttcacc

SEQ ID NO: 500 - DNA, 81 bp, Artificial sequence
  Codon-optimized polynucleotide
tggaagttcgagatgagctacaccgttggcggccctccaccacatgttcacgccagacctagacactggaaaaccgacaga

SEQ ID NO: 501 - DNA, 84 bp, Artificial sequence
  Codon-optimized polynucleotide
tacgaggccggcatgacactcggaggcaagatcctgttcttcctgttcctgctgctccctctgagccccttcagcctgatcttt

SEQ ID NO: 502 - protein, 15 aa, Homo sapiens
CQAVVTQALRFNPSF

SEQ ID NO: 503 - DNA, 99 bp, Artificial sequence
  Codon-optimized polynucleotide
acaggcggcaagagcacatgttctgcccctggacctcagtctctgcccagcacacccttcagcacataccctcagtgggtcatcctgatcaccgagctg

SEQ ID NO: 504 - DNA, 42 bp, Artificial sequence
  Codon-optimized polynucleotide
gtgctgcggttcctggatctcaaagtgcgctacctgcacagc

SEQ ID NO: 505 - DNA, 54 bp, Artificial sequence
  Codon-optimized polynucleotide
gattattgggcccagaaagaaaagggcagcagcagcttcctgcggcctagctgt

SEQ ID NO: 506 - DNA, 183 bp, Artificial sequence
  Codon-optimized polynucleotide
gtgcccttccgggaactgaagaacgtgtccgttctggaaggcctgaggcagggcagacttggcggaccttgtagctgccactgtcctagaccaagccaggccagactgacccctgtggatgtggctggcccatttctgtgtctgggcgaccctggactgttccctccagtgaagtctagcatc

SEQ ID NO: 507 - DNA, 177 bp, Artificial sequence
  Codon-optimized polynucleotide
ggcatggaatgtacactgggccaagtgggagccccatctcctagaagagaagaggatggctggcgcggaggccactctagattcaaagctgatgtgcccgctcctcagggcccttgttggggaggacaacctggatctgccccatcttctgccccacctgaacagagcctgctggat

SEQ ID NO: 508 - DNA, 96 bp, Artificial sequence
  Codon-optimized polynucleotide
ggcaacaccacactgcaacagctgggagaagcctctcaggccccaagcggttctctgatccctctcagactgcccctcctgtgggaagtgcggggc

SEQ ID NO: 509 - DNA, 129 bp, Artificial sequence
  Codon-optimized polynucleotide
gaggctttccagagagcagctggcgaaggcggacctggcagaggtggtgctagaagaggtgctagagtgctgcagagcccattctgtagagctggcgctggcgaatggctgggccaccaatctcttaga

SEQ ID NO: 510 - DNA, 51 bp, Artificial sequence
  Codon-optimized polynucleotide
gactattgggctcaaaaagagaagatcagcatccccagaacacacctgtgc

SEQ ID NO: 511 - DNA, 48 bp, Artificial sequence
  Codon-optimized polynucleotide
gtggccatgatggtgcccgacagacaggtgcactacgacttcggcctg

SEQ ID NO: 512 - DNA, 270 bp, Artificial sequence
  Codon-optimized polynucleotide
gtgcccttcagagagctgaaaaaccagagaacagcccagggcgctcctggaatccatcatgctgcttctccagtggccgccaatctgtgcgatcctgccagacatgcccagcataccaggattccttgtggcgctggacaagtgcgcgctggaagaggacctgaagctggtggcggagttctgcagcctcaaagacctgctcctgagaagcctggctgcccctgtagaagaggacagcctagactgcacaccgtgaagatgtggcgggcc

SEQ ID NO: 513 - DNA, 33 bp, Artificial sequence
  Codon-optimized polynucleotide
aagagaagcttcgccgtgaccgagcggatcatc

SEQ ID NO: 514 - DNA, 150 bp, Artificial sequence
  Codon-optimized polynucleotide
tttaagaagtttgacggcccctgcggcgagagaggcggaggaagaactgcaagagccctttgggccagaggcgactctgttctgacaccagctctggaccctcagacacctgttagggcccctagcctgacaagagctgccgctgctgtt

SEQ ID NO: 515 - DNA, 42 bp, Artificial sequence
  Codon-optimized polynucleotide
ctggtgctgggcgtgctgtctggccactctggaagcagactg

SEQ ID NO: 516 - DNA, 66 bp, Artificial sequence
  Codon-optimized polynucleotide
caatggcagcactaccacagatctggcgaagccgctggaaccccactttggaggcctaccagaaac

SEQ ID NO: 517 - DNA, 285 bp, Artificial sequence
  Codon-optimized polynucleotide
tgccacttgtttctccagccacaagtgggcacccctccacctcatacagcctctgctagagcacctagcggcccacctcatcctcacgaatcttgtcctgccggaagaaggcctgccagagccgctcaaacatgtgccagacgacagcacggactgcccggatgtgaagaagccggaacagccagagtgcctagcctgcaccttcatctgcatcaggccgctcttggagccggaagaggtagaggatggggagaagcttgtgcccaggtgccaccttctagaggc

SEQ ID NO: 518 - protein, 15 aa, Homo sapiens
LRFNPSFQEVCIYQD

SEQ ID NO: 519 - DNA, 225 bp, Artificial sequence
  Codon-optimized polynucleotide
cactacaagctgatccagcagccaatcagcctgttctccatcaccgaccggctgcacaagacattcagccagctgccttccgtgcatctgtgcagcatcaccttccagtggggacaccctcctatcttttgctccaccaacgacatctgcgtgaccgccaacttctgtatcagcgtgaccttcctgaagccttgctttctgctgcacgaggcctccgccagccag

SEQ ID NO: 520 - DNA, 432 bp, Artificial sequence
  Codon-optimized polynucleotide
cggaccgctctgacccacaaccaggacttcagcatctaccggctgtgctgcaagaggggctctctgtgtcatgctagccaggctagaagccccgcctttcctaagcctgtcagacctctgcctgctcctatcaccagaatcacccctcagctcggcggccagtctgattcatctcagccactgctgaccaccggcagacctcaaggatggcaagaccaggctctgagacacacacagcaggctagcccagcctcttgcgccaccatcacaataccaatacattctgccgctctgggcgatcacagcggagatcctggacctgcctgggatacttgtcctcctctgcccctaactacactgatccctagggctcctccaccttacggcgatagcacagccagatcctggcctagcagatgtggccctctgggc

SEQ ID NO: 521 - DNA, 201 bp, Artificial sequence
  Codon-optimized polynucleotide
tacgcctacaaggacttcctgtggtgcttccccttctctctggtgttcctgcaagaaatccagatctgctgtcacgtgtcctgcctgtgctgtatctgctgtagcacccggatctgtctgggctgtctgctggaactgttcctgagcagagccctgagagcactgcacgtgctgtggaacggattccagctgcactgccag

SEQ ID NO: 522 - DNA, 48 bp, Artificial sequence
  Codon-optimized polynucleotide
accatgcctgccattctgaagctgcagaagaattgtcttctaagcctg

SEQ ID NO: 523 - DNA, 72 bp, Artificial sequence
  Codon-optimized polynucleotide
tatgaggctggaatgaccctgggcgagaagttcagagtgggcaactgcaagcacctgaagatgacccggcct

SEQ ID NO: 524 - DNA, 51 bp, Artificial sequence
  Codon-optimized polynucleotide
ggagtgcctggcgattctactagaagggccgtgcggcggatgaacaccttt

SEQ ID NO: 525 - DNA, 48 bp, Artificial sequence
  Codon-optimized polynucleotide
tgtggcgcatctgcctgcgacgtgtccctgatcgctatggatagcgcc

SEQ ID NO: 526 - protein, 11 aa, Homo sapiens
EVCIYQDTDLM

SEQ ID NO: 527 - protein, 15 aa, Homo sapiens
WCPLDLRLGSTGCLT

SEQ ID NO: 528 - DNA, 72 bp, Artificial sequence
  Codon-optimized polynucleotide
accgagatcagctgctgcaccctgagcagcgaggaaaacgagtacctgcctagacctgaatggcagctgcag

SEQ ID NO: 529 - DNA, 42 bp, Artificial sequence
  Codon-optimized polynucleotide
tgcgaggaaagaggcgcagccggatctctgatctcttgcgag

SEQ ID NO: 530 - DNA, 48 bp, Artificial sequence
  Codon-optimized polynucleotide
aacagcaagatggccctgaatagcgaggccctgtctgtggtgtccgag

SEQ ID NO: 531 - DNA, 210 bp, Artificial sequence
  Codon-optimized polynucleotide
tggggaatggaactggccgctagcaggcggtttagctgggatcatcattctgccggcggacctccaagagtgccaagcgttagaagcggagcagcccaggtccagcctaaagatccactgccactgagaacactggccggctgccttgccagaacagctcatcttagacctggcgccgaaagcctgcctcaacctcagctgcattgcaca

SEQ ID NO: 532 - DNA, 60 bp, Artificial sequence
  Codon-optimized polynucleotide
cacgttgtcggctatggccacctggatacaagcggctcctctagcagtagctcctggcct

SEQ ID NO: 533 - DNA, 105 bp, Artificial sequence
  Codon-optimized polynucleotide
aattctaagatggctctcaacagcctgaactccatcgacgacgcccagctgacaagaatcgcccctccaagaagccactgttgcttttgggaagtgaacgcccct

SEQ ID NO: 534 - DNA, 48 bp, Artificial sequence
  Codon-optimized polynucleotide
aagatgcacttctcactgaaagagcacccgccaccgccgtgcccaccg

SEQ ID NO: 535 - DNA, 207 bp, Artificial sequence
  Codon-optimized polynucleotide
ctgtggttccagtccagcgaactgtctcctactggcgctccatggccaagcagaaggcctacttggagaggcaccaccgtgtctccaagaaccgctacaagcagcgccagaacctgttgcggcacaaaatggccctccagccaagaagctgccctcggacttggaagcggactgctgagattcagctgtggcacagccgccatcaga

SEQ ID NO: 536 - DNA, 51 bp, Artificial sequence
  Codon-optimized polynucleotide
atcgccagagaactgcaccagttcgccttcgacctgctgatcaagagccac

SEQ ID NO: 537 - DNA, 51 bp, Artificial sequence
  Codon-optimized polynucleotide
cagcctgacagctttgctgccctgcatagctccctgaatgagctgggcgaa

SEQ ID NO: 538 - DNA, 51 bp, Artificial sequence
  Codon-optimized polynucleotide
tttgtgcagggtaaagattggggcctcaaaaagtttatcagacgggacttc

SEQ ID NO: 539 - DNA, 51 bp, Artificial sequence
  Codon-optimized polynucleotide
ttcgtgcagggcaaagactggggcgtgaagaagttcatccggcgggacttt

SEQ ID NO: 540 - DNA, 204 bp, Artificial sequence
  Codon-optimized polynucleotide
cagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgcctttacc

SEQ ID NO: 541 - protein, 1479 aa, Artificial seqeunce
  Heterologous protein
QNLQNGGGSRSSATLPGRRRRRWLRRRRQPISVAPAGPPRRPNQKPNPPGGARCVIMRPTWPGTSAFTKRSFAVTERIIDYWAQKEKGSSSFLRPSCDYWAQKEKISIPRTHLCLVLGVLSGHSGSRLYEAGMTLGGKILFFLFLLLPLSPFSLIFTEISCCTLSSEENEYLPRPEWQLQVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDWKFEMSYTVGGPPPHVHARPRHWKTDRDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAP

SEQ ID NO: 542 - DNA, 4437 bp, Artificial seqeunce
  Heterologous polynucleotide
cagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgccttcaccaagagaagctttgccgtgaccgagcggatcatcgactattgggctcaaaaagagaagggcagcagcagcttcctgcggcctagctgtgattattgggcccagaaagaaaagatcagcatccccagaacacacctgtgcctggtgctgggagtgctgtctggacactctggcagcagactgtatgaggccggcatgacactcggcggcaagatcctgttcttcctgttcctgctgctccctctgagccccttcagcctgatcttcaccgagatcagctgctgcaccctgagcagcgaggaaaacgagtacctgcctagacctgagtggcagctgcaggtccccttcagagagctgaagaacgtttccgtgctggaaggcctgagacagggcagacttggcggcccttgtagctgtcactgccccagacctagtcaggccagactgacacctgtggatgtggccggacctttcctgtgtctgggagatcctggcctgtttccacctgtgaagtccagcatcacaggcggcaagtccacatgttctgcccctggacctcagagcctgcctagcacacccttcagcacataccctcagtgggtcatcctgatcaccgaactcggcatggaatgcaccctgggacaagtgggagccccatctcctagaagagaagaggatggctggcgcggaggccactctagattcaaagctgatgtgcccgctcctcagggcccttgttggggaggacaacctggatctgccccatcttctgccccacctgaacagtccctgctggattggaagttcgagatgagctacaccgtcggcggacctccacctcatgttcatgccagacctcggcactggaaaaccgacagagatggccacagctacaccagcaaagtgaactgcctcctgctgcaggatggcttccacggctgtgtgtctattactggcgccgctggcagacggaacctgagcatctttctgtttctgatgctgtgcaagctcgagttccacgcctgcaagatccagaacaagaactgccccgacttcaagaagttcgacggcccttgcggagaaagaggcggaggcagaacagctagagccctttgggctagaggcgacagcgttctgacaccagctctggaccctcagacacctgttagggcccctagcctgacaagagctgccgccgctgtgcactacaagctgatccagcagccaatcagcctgttcagcatcaccgaccggctgcacaagacattcagccagctgccaagcgtgcacctgtgctccatcaccttccagtggggacaccctcctatcttttgctccaccaacgacatctgcgtgaccgccaacttctgtatcagcgtgaccttcctgaagccttgctttctgctgcacgaggccagcgcctctcagtgccacttgtttctgcagccccaagtgggcacacctcctccacatacagcctctgctagagcacctagcggccctccacatcctcacgaatcttgtcctgccggaagaaggcctgccagagccgctcaaacatgtgccagacgacagcacggactgcctggatgtgaagaggctggaacagccagagtgcctagcctgcacctccatctgcatcaggctgctcttggagccggaagaggtagaggatggggcgaagcttgtgctcaggtgccaccttctagaggcgtgctgagattcctggacctgaaagtgcgctacctgcacagccagtggcagcactatcacagatctggcgaagccgccggaacacccctttggaggccaacaagaaacgtgcccttccgggaactgaagaaccagagaacagctcagggcgctcctggaatccaccatgctgcttctccagtggccgccaacctgtgtgatcctgccagacatgcccagcacaccaggattccttgtggcgctggacaagtgcgcgctggaagaggacctgaagcaggcggaggtgttctgcaacctcaaagacccgctcctgagaagcctggctgcccttgcagaagaggacagcctagactgcacaccgtgaaaatgtggcgagccgtggccatgatggtgcccgatagacaggtccactacgactttggactgggcgtgccaggcgatagcactcggagagccgtcagacggatgaacaccttttacgaagccgggatgaccctgggcgagaagttcagagtgggcaactgcaagcacctgaagatgacccggcctaacagcaagatggccctgaatagcgaggccctgtctgtggtgtctgaatgtggcgcctctgcctgtgacgtgtccctgatcgctatggactccgcctttgtgcagggcaaagactggggcgtgaagaagttcatccggcgggacttctacgcctacaaggacttcctgtggtgcttccccttctctctggtgttcctgcaagagatccagatctgctgtcatgtgtcctgcctgtgctgcatctgctgtagcaccagaatctgcctgggctgtctgctggaactgttcctgagcagagccctgagagcactgcacgtgctgtggaacggattccagctgcactgccagaccgagtacaaccagaaactgcaagtgaaccagttcagcgagagcaagagcctgtaccaccgggaaaagcagctcattgccatggacagcgccatctgcgaagagagaggcgccgcaggatctctgatctcctgcgaaacaatgcccgccatcctgaagctgcagaagaattgcctcctaagcctgcgaaccgctctgacacacaaccaggacttcagcatctacagactgtgttgcaagcggggctccctgtgccatgcaagccaagctagaagccccgcctttcctaaacctgtgcgacctctgccagctccaatcaccagaattacccctcagctcggcggccagagcgattcatctcaacctctgctgaccaccggcagacctcaaggctggcaagaccaagctctgagacacacccagcaggctagccctgcctcttgtgccaccatcacaatccccatccactctgccgctctgggcgatcattctggcgatcctggaccagcctgggacacatgtcctccactgccactcacaacactgatccctagggctcctccaccttacggcgattctaccgctagaagctggcccagcagatgtggaccactcggaggcaacacaaccctccagcaactgggagaagcctctcaggctcctagcggctctctgatccctctcagactgcctctcctgtgggaagttcggggccagcctgattcttttgccgcactgcacagctccctgaacgagctgggagagatcgctagagagctgcaccagttcgccttcgacctgctgatcaagagccacttcgtgcaaggcaaggattggggcctcaaaaagtttatccgcagagacttctggggcatggaactggccgccagcagaagattcagctgggatcatcatagcgcaggcggcccacctagagtgccatctgttagaagcggagctgcccaggtgcagcctaaagatcctctgccactgagaacactggccggctgccttgctagaacagcccatcttagacctggcgccgagtctctgcctcagccacaactgcactgtaccctgtggttccagtccagcgagctgtctcctactggtgccccttggccatctagacgccctacttggagaggcaccaccgtgtcaccaagaaccgccacaagcagcgccagaacctgttgtggcacaaagtggccctccagccaagaagccgctctcggacttggaagcggactgctgaggttctcttgtggaaccgccgccattcggaagatgcactttagcctgaaagaacaccctccaccaccttgtcctccagaggctttccaaagagctgctggcgaaggcggacctggtagaggtggtgctagaagaggtgctagggtgctgcagagcccattctgtagagcaggcgcaggcgaatggctgggccatcagagtctgagacatgtcgtcggctacggccacctggatacaagcggaagcagctctagctccagctggcctaactcaaaaatggctctgaacagcctgaactccatcgacgacgcccagctgacaagaatcgcccctcctagatctcactgctgcttttgggaagtgaacgcccca

SEQ ID NO: 543 - protein, 1479 aa, Artificial seqeunce
  Hetereologous protein
QNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELDGHSYTSKVNCLLLQDGFHGCVSITGAAGRRNLSIFLFLMLCKLEFHACQWQHYHRSGEAAGTPLWRPTRNVAMMVPDRQVHYDFGLKIQNKNCPDVLRFLDLKVRYLHSVPFRELKNQRTAQGAPGIHHAASPVAANLCDPARHAQHTRIPCGAGQVRAGRGPEAGGGVLQPQRPAPEKPGCPCRRGQPRLHTVKMWRACHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVGVPGDSTRRAVRRMNTFCGASACDVSLIAMDSACEERGAAGSLISCESLYHREKQLIAMDSAIFVQGKDWGVKKFIRRDFTMPAILKLQKNCLLSLNSKMALNSEALSVVSEYEAGMTLGEKFRVGNCKHLKMTRPTEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIR

SEQ ID NO: 544 - DNA, 4437 bp, Artificial seqeunce
  Heterologous polynucleotide
cagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgcctttaccggcatggaatgtacactgggccaagtgggagccccatctcctagaagagaagaggatggctggcgcggaggccactctagattcaaagctgatgtgcccgctcctcagggcccttgttggggaggacaacctggatctgccccatcttctgccccacctgaacagagcctgctggatgactattgggctcaaaaagagaagatcagcatccccagaacacacctgtgctggaagttcgagatgagctacaccgttggcggccctccaccacatgttcacgccagacctagacactggaaaaccgacagagattattgggcccagaaagaaaagggcagcagcagcttcctgcggcctagctgtgtgcccttccgggaactgaagaacgtgtccgttctggaaggcctgaggcagggcagacttggcggaccttgtagctgccactgtcctagaccaagccaggccagactgacccctgtggatgtggctggcccatttctgtgtctgggcgaccctggactgttccctccagtgaagtctagcatcaccgagatcagctgctgcaccctgagcagcgaggaaaacgagtacctgcctagacctgaatggcagctgcagtacgaggccggcatgacactcggaggcaagatcctgttcttcctgttcctgctgctccctctgagccccttcagcctgatctttctggtgctgggcgtgctgtctggccactctggaagcagactgaagagaagcttcgccgtgaccgagcggatcatcacaggcggcaagagcacatgttctgcccctggacctcagtctctgcccagcacacccttcagcacataccctcagtgggtcatcctgatcaccgagctggatggccacagctacaccagcaaagtgaactgcctcctgctgcaggatggcttccacggctgtgtgtctattactggcgccgctggcagacggaacctgagcatctttctgtttctgatgctgtgcaagctcgagttccacgcctgccaatggcagcactaccacagatctggcgaagccgctggaaccccactttggaggcctaccagaaacgtggccatgatggtgcccgacagacaggtgcactacgacttcggcctgaagatccagaacaagaactgccccgacgtgctgcggttcctggatctcaaagtgcgctacctgcacagcgtgcccttcagagagctgaaaaaccagagaacagcccagggcgctcctggaatccatcatgctgcttctccagtggccgccaatctgtgcgatcctgccagacatgcccagcataccaggattccttgtggcgctggacaagtgcgcgctggaagaggacctgaagctggtggcggagttctgcagcctcaaagacctgctcctgagaagcctggctgcccctgtagaagaggacagcctagactgcacaccgtgaagatgtggcgggcctgccacttgtttctccagccacaagtgggcacccctccacctcatacagcctctgctagagcacctagcggcccacctcatcctcacgaatcttgtcctgccggaagaaggcctgccagagccgctcaaacatgtgccagacgacagcacggactgcccggatgtgaagaagccggaacagccagagtgcctagcctgcaccttcatctgcatcaggccgctcttggagccggaagaggtagaggatggggagaagcttgtgcccaggtgccaccttctagaggccactacaagctgatccagcagccaatcagcctgttctccatcaccgaccggctgcacaagacattcagccagctgccttccgtgcatctgtgcagcatcaccttccagtggggacaccctcctatcttttgctccaccaacgacatctgcgtgaccgccaacttctgtatcagcgtgaccttcctgaagccttgctttctgctgcacgaggcctccgccagccagtttaagaagtttgacggcccctgcggcgagagaggcggaggaagaactgcaagagccctttgggccagaggcgactctgttctgacaccagctctggaccctcagacacctgttagggcccctagcctgacaagagctgccgctgctgttggagtgcctggcgattctactagaagggccgtgcggcggatgaacaccttttgtggcgcatctgcctgcgacgtgtccctgatcgctatggatagcgcctgcgaggaaagaggcgcagccggatctctgatctcttgcgagagcctgtaccaccgggaaaagcagctcattgccatggacagcgccatcttcgtgcagggcaaagactggggcgtgaagaagttcatccggcgggactttaccatgcctgccattctgaagctgcagaagaattgtcttctaagcctgaacagcaagatggccctgaatagcgaggccctgtctgtggtgtccgagtatgaggctggaatgaccctgggcgagaagttcagagtgggcaactgcaagcacctgaagatgacccggcctaccgagtacaaccagaaactgcaagtgaaccagttcagcgagagcaagcggaccgctctgacccacaaccaggacttcagcatctaccggctgtgctgcaagaggggctctctgtgtcatgctagccaggctagaagccccgcctttcctaagcctgtcagacctctgcctgctcctatcaccagaatcacccctcagctcggcggccagtctgattcatctcagccactgctgaccaccggcagacctcaaggatggcaagaccaggctctgagacacacacagcaggctagcccagcctcttgcgccaccatcacaataccaatacattctgccgctctgggcgatcacagcggagatcctggacctgcctgggatacttgtcctcctctgcccctaactacactgatccctagggctcctccaccttacggcgatagcacagccagatcctggcctagcagatgtggccctctgggctacgcctacaaggacttcctgtggtgcttccccttctctctggtgttcctgcaagaaatccagatctgctgtcacgtgtcctgcctgtgctgtatctgctgtagcacccggatctgtctgggctgtctgctggaactgttcctgagcagagccctgagagcactgcacgtgctgtggaacggattccagctgcactgccagggcaacaccacactgcaacagctgggagaagcctctcaggccccaagcggttctctgatccctctcagactgcccctcctgtgggaagtgcggggcaattctaagatggctctcaacagcctgaactccatcgacgacgcccagctgacaagaatcgcccctccaagaagccactgttgcttttgggaagtgaacgccccttttgtgcagggtaaagattggggcctcaaaaagtttatcagacgggacttcgaggctttccagagagcagctggcgaaggcggacctggcagaggtggtgctagaagaggtgctagagtgctgcagagcccattctgtagagctggcgctggcgaatggctgggccaccaatctcttagatggggaatggaactggccgctagcaggcggtttagctgggatcatcattctgccggcggacctccaagagtgccaagcgttagaagcggagcagcccaggtccagcctaaagatccactgccactgagaacactggccggctgccttgccagaacagctcatcttagacctggcgccgaaagcctgcctcaacctcagctgcattgcacaatcgccagagaactgcaccagttcgccttcgacctgctgatcaagagccacaagatgcacttctcactgaaagagcacccgccaccgccgtgcccaccgcacgttgtcggctatggccacctggatacaagcggctcctctagcagtagctcctggcctcagcctgacagctttgctgccctgcatagctccctgaatgagctgggcgaactgtggttccagtccagcgaactgtctcctactggcgctccatggccaagcagaaggcctacttggagaggcaccaccgtgtctccaagaaccgctacaagcagcgccagaacctgttgcggcacaaaatggccctccagccaagaagctgccctcggacttggaagcggactgctgagattcagctgtggcacagccgccatcaga

SEQ ID NO: 545 - DNA, 15 bp, Homo sapiens
cgcgacttcgccgcc

SEQ ID NO: 546 - DNA, 84 bp, Artificial seqeunce
  T cell enhancer
atgggccagaaagagcagatccacacactgcagaaaaacagcgagcggatgagcaagcagctgaccagatcttctcaggccgtg

SEQ ID NO: 547 - DNA, 21 bp, Artificial seqeunce
  Tag seqeunce
agccatcaccatcaccaccat

SEQ ID NO: 548 - protein, 12 aa, Homo sapiens
IKSLTAIFTVKF

SEQ ID NO: 549 - protein, 28 aa, Artificial sequence
  T cell enhancer
MGQKEQIHTLQKNSERMSKQLTRSSQAV

SEQ ID NO: 550 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTKRSFAVTERIIDYWAQKEKGSSSFLRPSCDYWAQKEKISIPRTHLCLVLGVLSGHSGSRLYEAGMTLGGKILFFLFLLLPLSPFSLIFTEISCCTLSSEENEYLPRPEWQLQVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDWKFEMSYTVGGPPPHVHARPRHWKTDRDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAP

SEQ ID NO: 551 - protein, 5703 aa, Artificial seqeunce
  Heterologous polypeptide
CCATTGCATACGTTGTATCCATATCATAATATGTACATTTATATTGGCTCATGTCCAACATTACCGCCATGTTGACATTGATTATTGACTAGTTATTAATAGTAATCAATTACGGGGTCATTAGTTCATAGCCCATATATGGAGTTCCGCGTTACATAACTTACGGTAAATGGCCCGCCTGGCTGACCGCCCAACGACCCCCGCCCATTGACGTCAATAATGACGTATGTTCCCATAGTAACGCCAATAGGGACTTTCCATTGACGTCAATGGGTGGAGTATTTACGGTAAACTGCCCACTTGGCAGTACATCAAGTGTATCATATGCCAAGTACGCCCCCTATTGACGTCAATGACGGTAAATGGCCCGCCTGGCATTATGCCCAGTACATGACCTTATGGGACTTTCCTACTTGGCAGTACATCTACGTATTAGTCATCGCTATTACCATGGTGATGCGGTTTTGGCAGTACATCAATGGGCGTGGATAGCGGTTTGACTCACGGGGATTTCCAAGTCTCCACCCCATTGACGTCAATGGGAGTTTGTTTTGGCACCAAAATCAACGGGACTTTCCAAAATGTCGTAACAACTCCGCCCCATTGACGCAAATGGGCGGTAGGCGTGTACGGTGGGAGGTCTATATAAGCAGAGCTCTCCCTATCAGTGATAGAGATCTCCCTATCAGTGATAGAGATCGTCGACGAGCTCGTTTAGTGAACCGTCAGATCGCCTGGAGACGCCATCCACGCTGTTTTGACCTCCATAGAAGACACCGGGACCGATCCAGCCTCCGCGGCCGGGAACGGTGCATTGGAACGCGGATTCCCCGTGCCAAGAGTGAGATCTTCCGTTTATCTAGGTACCAGATATCAGAATTCGGATCCCGCGACTTCGCCGCCATGGGCCAGAAAGAGCAGATCCACACACTGCAGAAAAACAGCGAGCGGATGAGCAAGCAGCTGACCAGATCTTCTCAGGCCGTGCAGAACCTGCAGAACGGCGGAGGCTCTAGAAGCTCTGCTACACTTCCTGGCAGGCGGCGGAGAAGATGGCTGAGAAGAAGGCGGCAGCCTATCTCTGTGGCTCCTGCTGGACCTCCTAGACGGCCCAACCAGAAGCCTAATCCTCCTGGCGGAGCCAGATGCGTGATCATGAGGCCTACATGGCCTGGCACCAGCGCCTTCACCAAGAGAAGCTTTGCCGTGACCGAGCGGATCATCGACTATTGGGCTCAAAAAGAGAAGGGCAGCAGCAGCTTCCTGCGGCCTAGCTGTGATTATTGGGCCCAGAAAGAAAAGATCAGCATCCCCAGAACACACCTGTGCCTGGTGCTGGGAGTGCTGTCTGGACACTCTGGCAGCAGACTGTATGAGGCCGGCATGACACTCGGCGGCAAGATCCTGTTCTTCCTGTTCCTGCTGCTCCCTCTGAGCCCCTTCAGCCTGATCTTCACCGAGATCAGCTGCTGCACCCTGAGCAGCGAGGAAAACGAGTACCTGCCTAGACCTGAGTGGCAGCTGCAGGTCCCCTTCAGAGAGCTGAAGAACGTTTCCGTGCTGGAAGGCCTGAGACAGGGCAGACTTGGCGGCCCTTGTAGCTGTCACTGCCCCAGACCTAGTCAGGCCAGACTGACACCTGTGGATGTGGCCGGACCTTTCCTGTGTCTGGGAGATCCTGGCCTGTTTCCACCTGTGAAGTCCAGCATCACAGGCGGCAAGTCCACATGTTCTGCCCCTGGACCTCAGAGCCTGCCTAGCACACCCTTCAGCACATACCCTCAGTGGGTCATCCTGATCACCGAACTCGGCATGGAATGCACCCTGGGACAAGTGGGAGCCCCATCTCCTAGAAGAGAAGAGGATGGCTGGCGCGGAGGCCACTCTAGATTCAAAGCTGATGTGCCCGCTCCTCAGGGCCCTTGTTGGGGAGGACAACCTGGATCTGCCCCATCTTCTGCCCCACCTGAACAGTCCCTGCTGGATTGGAAGTTCGAGATGAGCTACACCGTCGGCGGACCTCCACCTCATGTTCATGCCAGACCTCGGCACTGGAAAACCGACAGAGATGGCCACAGCTACACCAGCAAAGTGAACTGCCTCCTGCTGCAGGATGGCTTCCACGGCTGTGTGTCTATTACTGGCGCCGCTGGCAGACGGAACCTGAGCATCTTTCTGTTTCTGATGCTGTGCAAGCTCGAGTTCCACGCCTGCAAGATCCAGAACAAGAACTGCCCCGACTTCAAGAAGTTCGACGGCCCTTGCGGAGAAAGAGGCGGAGGCAGAACAGCTAGAGCCCTTTGGGCTAGAGGCGACAGCGTTCTGACACCAGCTCTGGACCCTCAGACACCTGTTAGGGCCCCTAGCCTGACAAGAGCTGCCGCCGCTGTGCACTACAAGCTGATCCAGCAGCCAATCAGCCTGTTCAGCATCACCGACCGGCTGCACAAGACATTCAGCCAGCTGCCAAGCGTGCACCTGTGCTCCATCACCTTCCAGTGGGGACACCCTCCTATCTTTTGCTCCACCAACGACATCTGCGTGACCGCCAACTTCTGTATCAGCGTGACCTTCCTGAAGCCTTGCTTTCTGCTGCACGAGGCCAGCGCCTCTCAGTGCCACTTGTTTCTGCAGCCCCAAGTGGGCACACCTCCTCCACATACAGCCTCTGCTAGAGCACCTAGCGGCCCTCCACATCCTCACGAATCTTGTCCTGCCGGAAGAAGGCCTGCCAGAGCCGCTCAAACATGTGCCAGACGACAGCACGGACTGCCTGGATGTGAAGAGGCTGGAACAGCCAGAGTGCCTAGCCTGCACCTCCATCTGCATCAGGCTGCTCTTGGAGCCGGAAGAGGTAGAGGATGGGGCGAAGCTTGTGCTCAGGTGCCACCTTCTAGAGGCGTGCTGAGATTCCTGGACCTGAAAGTGCGCTACCTGCACAGCCAGTGGCAGCACTATCACAGATCTGGCGAAGCCGCCGGAACACCCCTTTGGAGGCCAACAAGAAACGTGCCCTTCCGGGAACTGAAGAACCAGAGAACAGCTCAGGGCGCTCCTGGAATCCACCATGCTGCTTCTCCAGTGGCCGCCAACCTGTGTGATCCTGCCAGACATGCCCAGCACACCAGGATTCCTTGTGGCGCTGGACAAGTGCGCGCTGGAAGAGGACCTGAAGCAGGCGGAGGTGTTCTGCAACCTCAAAGACCCGCTCCTGAGAAGCCTGGCTGCCCTTGCAGAAGAGGACAGCCTAGACTGCACACCGTGAAAATGTGGCGAGCCGTGGCCATGATGGTGCCCGATAGACAGGTCCACTACGACTTTGGACTGGGCGTGCCAGGCGATAGCACTCGGAGAGCCGTCAGACGGATGAACACCTTTTACGAAGCCGGGATGACCCTGGGCGAGAAGTTCAGAGTGGGCAACTGCAAGCACCTGAAGATGACCCGGCCTAACAGCAAGATGGCCCTGAATAGCGAGGCCCTGTCTGTGGTGTCTGAATGTGGCGCCTCTGCCTGTGACGTGTCCCTGATCGCTATGGACTCCGCCTTTGTGCAGGGCAAAGACTGGGGCGTGAAGAAGTTCATCCGGCGGGACTTCTACGCCTACAAGGACTTCCTGTGGTGCTTCCCCTTCTCTCTGGTGTTCCTGCAAGAGATCCAGATCTGCTGTCATGTGTCCTGCCTGTGCTGCATCTGCTGTAGCACCAGAATCTGCCTGGGCTGTCTGCTGGAACTGTTCCTGAGCAGAGCCCTGAGAGCACTGCACGTGCTGTGGAACGGATTCCAGCTGCACTGCCAGACCGAGTACAACCAGAAACTGCAAGTGAACCAGTTCAGCGAGAGCAAGAGCCTGTACCACCGGGAAAAGCAGCTCATTGCCATGGACAGCGCCATCTGCGAAGAGAGAGGCGCCGCAGGATCTCTGATCTCCTGCGAAACAATGCCCGCCATCCTGAAGCTGCAGAAGAATTGCCTCCTAAGCCTGCGAACCGCTCTGACACACAACCAGGACTTCAGCATCTACAGACTGTGTTGCAAGCGGGGCTCCCTGTGCCATGCAAGCCAAGCTAGAAGCCCCGCCTTTCCTAAACCTGTGCGACCTCTGCCAGCTCCAATCACCAGAATTACCCCTCAGCTCGGCGGCCAGAGCGATTCATCTCAACCTCTGCTGACCACCGGCAGACCTCAAGGCTGGCAAGACCAAGCTCTGAGACACACCCAGCAGGCTAGCCCTGCCTCTTGTGCCACCATCACAATCCCCATCCACTCTGCCGCTCTGGGCGATCATTCTGGCGATCCTGGACCAGCCTGGGACACATGTCCTCCACTGCCACTCACAACACTGATCCCTAGGGCTCCTCCACCTTACGGCGATTCTACCGCTAGAAGCTGGCCCAGCAGATGTGGACCACTCGGAGGCAACACAACCCTCCAGCAACTGGGAGAAGCCTCTCAGGCTCCTAGCGGCTCTCTGATCCCTCTCAGACTGCCTCTCCTGTGGGAAGTTCGGGGCCAGCCTGATTCTTTTGCCGCACTGCACAGCTCCCTGAACGAGCTGGGAGAGATCGCTAGAGAGCTGCACCAGTTCGCCTTCGACCTGCTGATCAAGAGCCACTTCGTGCAAGGCAAGGATTGGGGCCTCAAAAAGTTTATCCGCAGAGACTTCTGGGGCATGGAACTGGCCGCCAGCAGAAGATTCAGCTGGGATCATCATAGCGCAGGCGGCCCACCTAGAGTGCCATCTGTTAGAAGCGGAGCTGCCCAGGTGCAGCCTAAAGATCCTCTGCCACTGAGAACACTGGCCGGCTGCCTTGCTAGAACAGCCCATCTTAGACCTGGCGCCGAGTCTCTGCCTCAGCCACAACTGCACTGTACCCTGTGGTTCCAGTCCAGCGAGCTGTCTCCTACTGGTGCCCCTTGGCCATCTAGACGCCCTACTTGGAGAGGCACCACCGTGTCACCAAGAACCGCCACAAGCAGCGCCAGAACCTGTTGTGGCACAAAGTGGCCCTCCAGCCAAGAAGCCGCTCTCGGACTTGGAAGCGGACTGCTGAGGTTCTCTTGTGGAACCGCCGCCATTCGGAAGATGCACTTTAGCCTGAAAGAACACCCTCCACCACCTTGTCCTCCAGAGGCTTTCCAAAGAGCTGCTGGCGAAGGCGGACCTGGTAGAGGTGGTGCTAGAAGAGGTGCTAGGGTGCTGCAGAGCCCATTCTGTAGAGCAGGCGCAGGCGAATGGCTGGGCCATCAGAGTCTGAGACATGTCGTCGGCTACGGCCACCTGGATACAAGCGGAAGCAGCTCTAGCTCCAGCTGGCCTAACTCAAAAATGGCTCTGAACAGCCTGAACTCCATCGACGACGCCCAGCTGACAAGAATCGCCCCTCCTAGATCTCACTGCTGCTTTTGGGAAGTGAACGCCCCAAGCCATCACCATCACCACCATTAGTAAAGGCGCGCCTAGCGGCCGCGATCTGCTGTGCCTTCTAGTTGCCAGCCATCTGTTGTTTGCCCCTCCCCCGTGCCTTCCTTGACCCTGGAAGGTGCCACTCCCACTGTCCTTTCCTAATAAAATGAGGAAATTGCATCGCATTGTCTGAGTAGGTGTCATTCTATTCTGGGGGGTGGGGTGGGGCAGGACAGCAAGGGGGAGGATTGGGAAGACAATAGCAGGCATGCTGGGGATGCGGTGGGCTCTATGGCC

SEQ ID NO: 552 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELDGHSYTSKVNCLLLQDGFHGCVSITGAAGRRNLSIFLFLMLCKLEFHACQWQHYHRSGEAAGTPLWRPTRNVAMMVPDRQVHYDFGLKIQNKNCPDVLRFLDLKVRYLHSVPFRELKNQRTAQGAPGIHHAASPVAANLCDPARHAQHTRIPCGAGQVRAGRGPEAGGGVLQPQRPAPEKPGCPCRRGQPRLHTVKMWRACHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVGVPGDSTRRAVRRMNTFCGASACDVSLIAMDSACEERGAAGSLISCESLYHREKQLIAMDSAIFVQGKDWGVKKFIRRDFTMPAILKLQKNCLLSLNSKMALNSEALSVVSEYEAGMTLGEKFRVGNCKHLKMTRPTEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIR

SEQ ID NO: 553 - DNA, 4722 bp, Artificial seqeunce
  Heterologous polynucleotide
gatcactaattccaaacccacccgctttttatagtaagtttttcacccataaataataaatacaataattaatttctcgtaaaagtagaaaatatattctaatttattgcacggtaaggaagtagaatcataaagaacagtgacggatcccgcgacttcgccgccatgggccagaaagagcagatccacacactgcagaaaaacagcgagcggatgagcaagcagctgaccagatcttctcaggccgtgcagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgcctttaccggcatggaatgtacactgggccaagtgggagccccatctcctagaagagaagaggatggctggcgcggaggccactctagattcaaagctgatgtgcccgctcctcagggcccttgttggggaggacaacctggatctgccccatcttctgccccacctgaacagagcctgctggatgactattgggctcaaaaagagaagatcagcatccccagaacacacctgtgctggaagttcgagatgagctacaccgttggcggccctccaccacatgttcacgccagacctagacactggaaaaccgacagagattattgggcccagaaagaaaagggcagcagcagcttcctgcggcctagctgtgtgcccttccgggaactgaagaacgtgtccgttctggaaggcctgaggcagggcagacttggcggaccttgtagctgccactgtcctagaccaagccaggccagactgacccctgtggatgtggctggcccatttctgtgtctgggcgaccctggactgttccctccagtgaagtctagcatcaccgagatcagctgctgcaccctgagcagcgaggaaaacgagtacctgcctagacctgaatggcagctgcagtacgaggccggcatgacactcggaggcaagatcctgttcttcctgttcctgctgctccctctgagccccttcagcctgatctttctggtgctgggcgtgctgtctggccactctggaagcagactgaagagaagcttcgccgtgaccgagcggatcatcacaggcggcaagagcacatgttctgcccctggacctcagtctctgcccagcacacccttcagcacataccctcagtgggtcatcctgatcaccgagctggatggccacagctacaccagcaaagtgaactgcctcctgctgcaggatggcttccacggctgtgtgtctattactggcgccgctggcagacggaacctgagcatctttctgtttctgatgctgtgcaagctcgagttccacgcctgccaatggcagcactaccacagatctggcgaagccgctggaaccccactttggaggcctaccagaaacgtggccatgatggtgcccgacagacaggtgcactacgacttcggcctgaagatccagaacaagaactgccccgacgtgctgcggttcctggatctcaaagtgcgctacctgcacagcgtgcccttcagagagctgaaaaaccagagaacagcccagggcgctcctggaatccatcatgctgcttctccagtggccgccaatctgtgcgatcctgccagacatgcccagcataccaggattccttgtggcgctggacaagtgcgcgctggaagaggacctgaagctggtggcggagttctgcagcctcaaagacctgctcctgagaagcctggctgcccctgtagaagaggacagcctagactgcacaccgtgaagatgtggcgggcctgccacttgtttctccagccacaagtgggcacccctccacctcatacagcctctgctagagcacctagcggcccacctcatcctcacgaatcttgtcctgccggaagaaggcctgccagagccgctcaaacatgtgccagacgacagcacggactgcccggatgtgaagaagccggaacagccagagtgcctagcctgcaccttcatctgcatcaggccgctcttggagccggaagaggtagaggatggggagaagcttgtgcccaggtgccaccttctagaggccactacaagctgatccagcagccaatcagcctgttctccatcaccgaccggctgcacaagacattcagccagctgccttccgtgcatctgtgcagcatcaccttccagtggggacaccctcctatcttttgctccaccaacgacatctgcgtgaccgccaacttctgtatcagcgtgaccttcctgaagccttgctttctgctgcacgaggcctccgccagccagtttaagaagtttgacggcccctgcggcgagagaggcggaggaagaactgcaagagccctttgggccagaggcgactctgttctgacaccagctctggaccctcagacacctgttagggcccctagcctgacaagagctgccgctgctgttggagtgcctggcgattctactagaagggccgtgcggcggatgaacaccttttgtggcgcatctgcctgcgacgtgtccctgatcgctatggatagcgcctgcgaggaaagaggcgcagccggatctctgatctcttgcgagagcctgtaccaccgggaaaagcagctcattgccatggacagcgccatcttcgtgcagggcaaagactggggcgtgaagaagttcatccggcgggactttaccatgcctgccattctgaagctgcagaagaattgtcttctaagcctgaacagcaagatggccctgaatagcgaggccctgtctgtggtgtccgagtatgaggctggaatgaccctgggcgagaagttcagagtgggcaactgcaagcacctgaagatgacccggcctaccgagtacaaccagaaactgcaagtgaaccagttcagcgagagcaagcggaccgctctgacccacaaccaggacttcagcatctaccggctgtgctgcaagaggggctctctgtgtcatgctagccaggctagaagccccgcctttcctaagcctgtcagacctctgcctgctcctatcaccagaatcacccctcagctcggcggccagtctgattcatctcagccactgctgaccaccggcagacctcaaggatggcaagaccaggctctgagacacacacagcaggctagcccagcctcttgcgccaccatcacaataccaatacattctgccgctctgggcgatcacagcggagatcctggacctgcctgggatacttgtcctcctctgcccctaactacactgatccctagggctcctccaccttacggcgatagcacagccagatcctggcctagcagatgtggccctctgggctacgcctacaaggacttcctgtggtgcttccccttctctctggtgttcctgcaagaaatccagatctgctgtcacgtgtcctgcctgtgctgtatctgctgtagcacccggatctgtctgggctgtctgctggaactgttcctgagcagagccctgagagcactgcacgtgctgtggaacggattccagctgcactgccagggcaacaccacactgcaacagctgggagaagcctctcaggccccaagcggttctctgatccctctcagactgcccctcctgtgggaagtgcggggcaattctaagatggctctcaacagcctgaactccatcgacgacgcccagctgacaagaatcgcccctccaagaagccactgttgcttttgggaagtgaacgccccttttgtgcagggtaaagattggggcctcaaaaagtttatcagacgggacttcgaggctttccagagagcagctggcgaaggcggacctggcagaggtggtgctagaagaggtgctagagtgctgcagagcccattctgtagagctggcgctggcgaatggctgggccaccaatctcttagatggggaatggaactggccgctagcaggcggtttagctgggatcatcattctgccggcggacctccaagagtgccaagcgttagaagcggagcagcccaggtccagcctaaagatccactgccactgagaacactggccggctgccttgccagaacagctcatcttagacctggcgccgaaagcctgcctcaacctcagctgcattgcacaatcgccagagaactgcaccagttcgccttcgacctgctgatcaagagccacaagatgcacttctcactgaaagagcacccgccaccgccgtgcccaccgcacgttgtcggctatggccacctggatacaagcggctcctctagcagtagctcctggcctcagcctgacagctttgctgccctgcatagctccctgaatgagctgggcgaactgtggttccagtccagcgaactgtctcctactggcgctccatggccaagcagaaggcctacttggagaggcaccaccgtgtctccaagaaccgctacaagcagcgccagaacctgttgcggcacaaaatggccctccagccaagaagctgccctcggacttggaagcggactgctgagattcagctgtggcacagccgccatcagaagccatcaccatcaccaccattagtaaaggcgcgcc

SEQ ID NO: 554 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTKRSFAVTERIILVLGVLSGHSGSRLYEAGMTLGGKILFFLFLLLPLSPFSLIFTEISCCTLSSEENEYLPRPEWQLQVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDDYWAQKEKGSSSFLRPSCDYWAQKEKISIPRTHLCWKFEMSYTVGGPPPHVHARPRHWKTDRGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAP

SEQ ID NO: 555 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTKRSFAVTERIITEISCCTLSSEENEYLPRPEWQLQYEAGMTLGGKILFFLFLLLPLSPFSLIFDYWAQKEKGSSSFLRPSCVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDDYWAQKEKISIPRTHLCLVLGVLSGHSGSRLWKFEMSYTVGGPPPHVHARPRHWKTDRDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAP

SEQ ID NO: 556 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTKRSFAVTERIIDYWAQKEKGSSSFLRPSCVPFRELKNVSVLEGLRQGRLGGPCSCHCPRPSQARLTPVDVAGPFLCLGDPGLFPPVKSSILVLGVLSGHSGSRLYEAGMTLGGKILFFLFLLLPLSPFSLIFTEISCCTLSSEENEYLPRPEWQLQTGGKSTCSAPGPQSLPSTPFSTYPQWVILITELGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAP

SEQ ID NO: 557 - protein, 1507 aa, Artificial seqeunce
  Heterologous polypeptide
MGQKEQIHTLQKNSERMSKQLTRSSQAVQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELDGHSYTSKVNCLLLQDGFHGCVSITGAAGRRNLSIFLFLMLCKLEFHACCHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQVAMMVPDRQVHYDFGLKIQNKNCPDVLRFLDLKVRYLHSVPFRELKNQRTAQGAPGIHHAASPVAANLCDPARHAQHTRIPCGAGQVRAGRGPEAGGGVLQPQRPAPEKPGCPCRRGQPRLHTVKMWRAQWQHYHRSGEAAGTPLWRPTRNFKKFDGPCGERGGGRTARALWARGDSVLTPALDPQTPVRAPSLTRAAAAVGVPGDSTRRAVRRMNTFCGASACDVSLIAMDSACEERGAAGSLISCESLYHREKQLIAMDSAIFVQGKDWGVKKFIRRDFTMPAILKLQKNCLLSLNSKMALNSEALSVVSEYEAGMTLGEKFRVGNCKHLKMTRPTEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIR

SEQ ID NO: 558 - protein, 1507 aa, Artificial seqeunce
  Heterologous polypeptide
MGQKEQIHTLQKNSERMSKQLTRSSQAVDGHSYTSKVNCLLLQDGFHGCVSITGAAGRRNLSIFLFLMLCKLEFHACQWQHYHRSGEAAGTPLWRPTRNVAMMVPDRQVHYDFGLVLRFLDLKVRYLHSKIQNKNCPDVPFRELKNQRTAQGAPGIHHAASPVAANLCDPARHAQHTRIPCGAGQVRAGRGPEAGGGVLQPQRPAPEKPGCPCRRGQPRLHTVKMWRACHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELGVPGDSTRRAVRRMNTFCGASACDVSLIAMDSACEERGAAGSLISCESLYHREKQLIAMDSAIFVQGKDWGVKKFIRRDFTMPAILKLQKNCLLSLNSKMALNSEALSVVSEYEAGMTLGEKFRVGNCKHLKMTRPTEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIR

SEQ ID NO: 559 - protein, 1507 aa, Artificial seqeunce
  Heterologous polypeptide
MGQKEQIHTLQKNSERMSKQLTRSSQAVGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIRDGHSYTSKVNCLLLQDGFHGCVSITGAAGRRNLSIFLFLMLCKLEFHACQWQHYHRSGEAAGTPLWRPTRNVAMMVPDRQVHYDFGLKIQNKNCPDVLRFLDLKVRYLHSVPFRELKNQRTAQGAPGIHHAASPVAANLCDPARHAQHTRIPCGAGQVRAGRGPEAGGGVLQPQRPAPEKPGCPCRRGQPRLHTVKMWRACHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVGVPGDSTRRAVRRMNTFCGASACDVSLIAMDSATEYNQKLQVNQFSESKYEAGMTLGEKFRVGNCKHLKMTRPTMPAILKLQKNCLLSLNSKMALNSEALSVVSECEERGAAGSLISCESLYHREKQLIAMDSAIFVQGKDWGVKKFIRRDFRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITEL

SEQ ID NO: 560 - protein, 15 aa, Homo sapiens
WKFEMSYTVGGPPPH

SEQ ID NO: 561 - protein, 15 aa, Homo sapiens
VGGPPPHVHARPRHW

SEQ ID NO: 562 - protein, 14 aa, Homo sapiens
PPHVHARPRHWKTD

SEQ ID NO: 563 - protein, 15 aa, Homo sapiens
YEAGMTLGGKILFFL

SEQ ID NO: 564 - protein, 15 aa, Homo sapiens
GKILFFLFLLLPLSP

SEQ ID NO: 565 - protein, 16 aa, Homo sapiens
FFLFLLLPLSPFSLIF

SEQ ID NO: 566 - protein, 15 aa, Homo sapiens
DGHSYTSKVNCLLLQ

SEQ ID NO: 567 - protein, 15 aa, Homo sapiens
VNCLLLQDGFHGCVS

SEQ ID NO: 568 - protein, 15 aa, Homo sapiens
GFHGCVSITGAAGRR

SEQ ID NO: 569 - protein, 15 aa, Homo sapiens
TGAAGRRNLSIFLFL

SEQ ID NO: 570 - protein, 15 aa, Homo sapiens
LSIFLFLMLCKLEFH

SEQ ID NO: 571 - protein, 13 aa, Homo sapiens
LFLMLCKLEFHAC

SEQ ID NO: 572 - protein, 15 aa, Homo sapiens
TGGKSTCSAPGPQSL

SEQ ID NO: 573 - protein, 15 aa, Homo sapiens
APGPQSLPSTPFSTY

SEQ ID NO: 574 - protein, 15 aa, Homo sapiens
STPFSTYPQWVILIT

SEQ ID NO: 575 - protein, 15 aa, Homo sapiens
SRSSATLPGRRRRRW

SEQ ID NO: 576 - protein, 15 aa, Homo sapiens
DYWAQKEKGSSSFLR

SEQ ID NO: 577 - protein, 14 aa, Homo sapiens
QKEKGSSSFLRPSC

SEQ ID NO: 578 - protein, 15 aa, Homo sapiens
VPFRELKNVSVLEGL

SEQ ID NO: 579 - protein, 15 aa, Homo sapiens
VSVLEGLRQGRLGGP

SEQ ID NO: 580 - protein, 15 aa, Homo sapiens
QGRLGGPCSCHCPRP

SEQ ID NO: 581 - protein, 15 aa, Homo sapiens
SCHCPRPSQARLTPV

SEQ ID NO: 582 - protein, 15 aa, Homo sapiens
QARLTPVDVAGPFLC

SEQ ID NO: 583 - protein, 15 aa, Homo sapiens
VAGPFLCLGDPGLFP

SEQ ID NO: 584 - protein, 13 aa, Homo sapiens
GDPGLFPPVKSSI

SEQ ID NO: 585 - protein, 15 aa, Homo sapiens
GMECTLGQVGAPSPR

SEQ ID NO: 586 - protein, 15 aa, Homo sapiens
VGAPSPRREEDGWRG

SEQ ID NO: 587 - protein, 15 aa, Homo sapiens
EEDGWRGGHSRFKAD

SEQ ID NO: 588 - protein, 15 aa, Homo sapiens
HSRFKADVPAPQGPC

SEQ ID NO: 589 - protein, 15 aa, Homo sapiens
PAPQGPCWGGQPGSA

SEQ ID NO: 590 - protein, 15 aa, Homo sapiens
GGQPGSAPSSAPPEQ

SEQ ID NO: 591 - protein, 15 aa, Homo sapiens
GSAPSSAPPEQSLLD

SEQ ID NO: 592 - protein, 15 aa, Homo sapiens
GNTTLQQLGEASQAP

SEQ ID NO: 593 - protein, 15 aa, Homo sapiens
GEASQAPSGSLIPLR

SEQ ID NO: 594 - protein, 16 aa, Homo sapiens
GSLIPLRLPLLWEVRG

SEQ ID NO: 595 - protein, 15 aa, Homo sapiens
EAFQRAAGEGGPGRG

SEQ ID NO: 596 - protein, 15 aa, Homo sapiens
EGGPGRGGARRGARV

SEQ ID NO: 597 - protein, 15 aa, Homo sapiens
ARRGARVLQSPFCRA

SEQ ID NO: 598 - protein, 15 aa, Homo sapiens
QSPFCRAGAGEWLGH

SEQ ID NO: 599 - protein, 15 aa, Homo sapiens
CRAGAGEWLGHQSLR

SEQ ID NO: 600 - protein, 15 aa, Homo sapiens
DYWAQKEKISIPRTH

SEQ ID NO: 601 - protein, 13 aa, Homo sapiens
QKEKISIPRTHLC

SEQ ID NO: 602 - protein, 15 aa, Homo sapiens
VAMMVPDRQVHYDFG

SEQ ID NO: 603 - protein, 13 aa, Homo sapiens
VPDRQVHYDFGLR

SEQ ID NO: 604 - protein, 15 aa, Homo sapiens
FKKFDGPCGERGGGR

SEQ ID NO: 605 - protein, 15 aa, Homo sapiens
GERGGGRTARALWAR

SEQ ID NO: 606 - protein, 15 aa, Homo sapiens
ARALWARGDSVLTPA

SEQ ID NO: 607 - protein, 15 aa, Homo sapiens
DSVLTPALDPQTPVR

SEQ ID NO: 608 - protein, 15 aa, Homo sapiens
DPQTPVRAPSLTRAA

SEQ ID NO: 609 - protein, 14 aa, Homo sapiens
PVRAPSLTRAAAAV

SEQ ID NO: 610 - protein, 15 aa, Homo sapiens
GRRRRRWLRRRRQPI

SEQ ID NO: 611 - protein, 15 aa, Homo sapiens
GVPGDSTRRAVRRMN

SEQ ID NO: 612 - protein, 13 aa, Homo sapiens
DSTRRAVRRMNTF

SEQ ID NO: 613 - protein, 15 aa, Homo sapiens
RRRRQPISVAPAGPP

SEQ ID NO: 614 - protein, 15 aa, Homo sapiens
VAPAGPPRRPNQKPN

SEQ ID NO: 615 - protein, 15 aa, Homo sapiens
TEISCCTLSSEENEY

SEQ ID NO: 616 - protein, 16 aa, Homo sapiens
SSEENEYLPRPEWQLQ

SEQ ID NO: 617 - protein, 15 aa, Homo sapiens
RPNQKPNPPGGARCV

SEQ ID NO: 618 - protein, 15 aa, Homo sapiens
PGGARCVIMRPTWPG

SEQ ID NO: 619 - protein, 15 aa, Homo sapiens
HVVGYGHLDTSGSSS

SEQ ID NO: 620 - protein, 16 aa, Homo sapiens
YGHLDTSGSSSSSSWP

SEQ ID NO: 621 - protein, 12 aa, Homo sapiens
MRPTWPGTSAFT

SEQ ID NO: 622 - DNA, 32363 bp, Artificial sequence
  GAd20
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgcggagggtatttaaacccgctgcgctcctaaagaggccactcttgagtgccagcgagaagagttttctcctccgctccgtttcggcgatcgaaaaatgagacatttagcctgcactccgggtcttttgtccggccgggcggcgtccgagcttttggacgctttgctcaatgaggttctgagcgatgattttccgtctactacccactttagcccacctactcttcacgaactgtacgatctggatgtactggtggatgtgaacgatcccaacgaggaggcggtttctacgttttttcccgagtctgcgcttttggctgcccaggagggatttgacctacacactccgccgctgcctattttagagtctccgctgccggagcccagtggtataccttatatgcctgaactgcttcccgaagtggtagacctgacctgccacgagccgggctttccgcccagcgacgatgagggtgagccttttgctttagactatgctgagatacctgggctcggttgcaggtcttgtgcatatcatcagagggttaccggagaccccgaggttaagtgttcgctgtgctatatgaggctgacctcttcctttatctacagtaagtttttttgtgtaggtgggctttttgggtaggtgggttttgtggcaggacaggtgtaaatgttgcttgtgttttttgtacctgcaggtccggtgtccgagccagacccggagcccgaccgcgatcccgagccggatcccgagcctcctcgcaggccaaggaaattaccttccattttgtgcaagcctaagacacctgtgaggaccagcgaggcggacagcactgactctggcacttctacctctcctcctgaaattcacccagtggttcctctgggtatacatagacctgttgctgttagagtttgcgggcgacgccctgcagtagagtgcattgaggacttgcttaacgatcccgagggacctttggacttgagcattaaacgccctaggcaataaaccccacctaagtaataaaccccacctaagtaataaactttaccgcccttggttattgagatgacgcccaatgtttgcttttgaatgacttcatgtgtataataaaagtgagtgtggtcataggtctcttgtttgtctgggcggggtttaagggtatataagtttctcggggctaaacttggttacacttgaccccaatggaggcgtgggggtgcttggaggagtttgcggacgtgcgccgtttgctggacgagagctctagcaatacctatagtatttggaggtatctgtggggctctactcaggccaagttggtcttcagaattaagcaggattacaagtgcgattttgaagagctttttagttcctgtggtgagcttttgcaatccttgaatctgggccaccaggctatcttccaggaaaaggttctctcgactttggatttttccactcccgggcgcaccgccgcttgtgtggcttttgtgtcttttgtgcaagataaatggagcggggagacccacctgagtcacggctacgtgctggatttcatggcgatggctctttggagggcttacaacaaatggaagattcagaaggaactgtacggttccgccctacgtcgtccacttctgcagcggcaggggctgatgtttcccgaccatcgccagcatcagaatctggaagacgagcgagcggagaagatcagcttgagagccggcctggaccctcctcaggaggaatgaatctcccgcaggtggttgagctgtttcccgaactgagacgggtcctgactatcagggaggatggtcagtttgtgaagaagctgaagagggatcggggtgagggagatgatgaggcggctagcaatttagcttttagtctgataactcgccaccgaccggaatgtattacctatcagcagattaaggagagttgtgccaacgagctggatcttttgggtcagaagtatagcatagaacagcttaccacttactggcttcagcccggggatgattgggaagaggcgattagggtgtatgcaaaggtggccctgcggcccgattgcaagtataagattactaagttggttaatattagaaactgctgctatatttctggaaacggggccgaagtggagatagatactgaggacagggtggctattaggtgttgcatgataaacatgtggcccgggatactggggatggatggggtgatatttatgaatgtgaggttcacgggccccaactttaatggtacggtgttcatgggcaacaccaacttgctcctgcatggtgcgagtttctatgggtttaacaacacctgtatagaggcctggaccgatgtaaaggttcgaggttgttccttttatagctgttggaaggcggtggtgtgtcgccctaaaagcaggggttctgtgaagaaatgcttgtttgaaaggtgcaccctaggtatcctttctgagggcaactccagggtgcgccataatgtggcttcgaactgcggttgcttcatgcaagtgaagggggtgagcgttatcaagcataactcggtctgtggaaactgcgaggatcgcgcctctcagatgctgacctgctttgatggcaactgtcacctgttgaagaccattcatataagcagtcaccccagaaaggcctggcccgtgtttgagcataacattctgacccgctgttccttgcatctgggggtcaggaggggtatgttcctgccttaccagtgtaactttagccacactaaaatcctgctggaacccgagtgcatgactaaggtcagcctgaatggtgtgtttgatgtgagtctgaagatttggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttcctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagatttccaaggatggtatccaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttctgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcgggctcctgtcgccatcctgtcaacgccaccgtccaagcccggcccgatcagcccgaggtgaacctcacctgtggtctgcaccggcgcctgaggaaatacctagcttggtactacaacagcactccctttgtggtttacaacagctttgaccaggacggggtctcactgagggataacctctcgaacctgagctactccatcaggaagaacaacaccctcgagctacttcctccttacctgcccgggacttaccagtgtgtcaccggcccctgcacccacacccacctgttgatcgtaaacgactctcttccgagaacagacctcaataactcctctccgcagttccccagaacaggaggtgagctcaggaaaccccgggtaaagaagggtggacaagagttaacacttgtggggtttctggtatatgtgacgctggtggtggctcttttgattaaggcttttccttccatgtctgaactatccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccaccgcaggtagaataatgctgcttaccctctttgtcctggcgctggctgccagctgccaagccttttccgaggctgacttcatagagccccagtgcaatatcacttataaatctgaacgtgccatctgtactattctaatcaaatgtgttactcaacacgataaggtgactgttaaatacaaagatcaattaaaaaaagacgcactttacagcagctggcaaccaggagatgatcaaaaatacaatgtaaccgtcttccagggcaaactctccaaaacttacaattacaatttcccatttgagcagatgtgtgactttgtcatgtacatggaaaagcagtacaagctgtggcctccaactccccagggctgtgtggaaaatccaggctctttctgtatgatctctctctgtgtaactgtgctggcactaatactcacgcttctgtatctcagatttaaatcaaggcaaagcttcattgatgaaaagaaaatgccataatcgctcaacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtttcttactgcactaacaaaaacagccacaagcccagagccatctgcgatgggcaaaatctaaccttgattgatgttcaattgctggatgcgggctactattatgggcagctgggtacaatgattaattactggagaccccacagagattacatgcttcacgtagtaaagggtcccattagcagcccaaccaccacctctaccacacccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgccattgcccaggatttggaagatcacgaggaagatgagcatgactacgcagatgcatgccaggcatcagaggcagaagcgctaccggtggccctaaaacagtatgcagactcccacaccacccccaaccttcctccaccttcccagaagccaagtttcctgggggaaaatgaaactctgcctctttccatactagctctgacatctgttgctattttggccgctctgctggtgcttctatgctctatatgctacctgatctgctgcagaaagaaaaaatctcacggccatgctcaccagcccctcatgcacttcccttaccctccagagctgggcgaccacaaactttaagtctgcagtagctatctgcccatcccttgtcagtcgacagcgatgagccccactaatctaacagcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggcccttcgtcatcacacctgaagataatgatgatgatgacaccacctccaggctgcagagcctaaagcagctactcttctcttttacagcatggtaaattgaatcatgccccgcattttcatctacttgcttctccttccactttttctgggctcctctacattggccactgtgtcccacatcgaggtagactgcctcacgcccttcacagtctacctgcttttcggctttgtcatctgcacctttgtctgcagcgttatcactgtagtgatctgcttcatacagtgcatcgactacatctgtgtgcgggtggcctactttagacaccacccccagtatcgcaacagggacatagcggctctcctaagacttgtttaaatcatggccaaattacctgtgattggtcttctgattatctgctgcgtcctagccgcgattgggactcaacctaataccaccaccagcgctcccagaaagagacatgtatcctgcagcttcaagcgtccctggaatataccccaatgctttactgatgaacctgaaatctctttggcttggtacttcagcgtcaccgcccttctcatcttctgcagtacggttattgctcttgccatctacccttcccttaacctgggctggaatgctgtcaactctatggaatatcccaccttcccagaaccagacctgccagacctggttgttctaaacgcgtttcctcctcctccagttcaaaatcagtttcgccctccgtcccctacgcccactgaggtcagctactttaatctaacaggcggagatgactgaaaacctagacctagaaatggacggtctctgcagcgagcaacgcacactagagaggcgccggcaaaaagcagagctcgagcgtcttaaacaagagctccaagacgccgtggccatacaccagtgcaaaaaagggctcttctgtctggtaaaacaggccacgctcacctatgaaaaaacaggtgacacccaccgcctaggatacaagctgcccacacagcgccaaaagtttgcccttatgataggtgaacaacccatcaccgtcacccagcactccgtggagacagaaggctgcattcatgctccctgcaggggcgctgactgcctctacaccttgatcaaaaccctctgcggtctcagagaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctg

SEQ ID NO: 623 - protein, 1507 aa, Artificial seqeunce
  Heterologous polypeptide
MGQKEQIHTLQKNSERMSKQLTRSSQAVGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAPDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLQNLQNGGGSRSSATLPGRRRRRWLRRRRQPISVAPAGPPRRPNQKPNPPGGARCVIMRPTWPGTSAFTKRSFAVTERIILVLGVLSGHSGSRLYEAGMTLGGKILFFLFLLLPLSPFSLIFTEISCCTLSSEENEYLPRPEWQLQVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDDYWAQKEKGSSSFLRPSCDYWAQKEKISIPRTHLCWKFEMSYTVGGPPPHVHARPRHWKTDR

SEQ ID NO: 624 - protein, 1507 aa, Artificial seqeunce
  Heterologous polypeptide
MGQKEQIHTLQKNSERMSKQLTRSSQAVGNTTLQQLGEASQAPSGSLIPLRLPLLWEVRGQPDSFAALHSSLNELGEIARELHQFAFDLLIKSHFVQGKDWGLKKFIRRDFWGMELAASRRFSWDHHSAGGPPRVPSVRSGAAQVQPKDPLPLRTLAGCLARTAHLRPGAESLPQPQLHCTLWFQSSELSPTGAPWPSRRPTWRGTTVSPRTATSSARTCCGTKWPSSQEAALGLGSGLLRFSCGTAAIRKMHFSLKEHPPPPCPPEAFQRAAGEGGPGRGGARRGARVLQSPFCRAGAGEWLGHQSLRHVVGYGHLDTSGSSSSSSWPNSKMALNSLNSIDDAQLTRIAPPRSHCCFWEVNAPGVPGDSTRRAVRRMNTFYEAGMTLGEKFRVGNCKHLKMTRPNSKMALNSEALSVVSECGASACDVSLIAMDSAFVQGKDWGVKKFIRRDFYAYKDFLWCFPFSLVFLQEIQICCHVSCLCCICCSTRICLGCLLELFLSRALRALHVLWNGFQLHCQTEYNQKLQVNQFSESKSLYHREKQLIAMDSAICEERGAAGSLISCETMPAILKLQKNCLLSLRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGDGHSYTSKVNCLLLQDGFHGCVSITGAAGRRNLSIFLFLMLCKLEFHACKIQNKNCPDFKKFDGPCGERGGGRTARALWARGDSVLTPALDPQTPVRAPSLTRAAAAVHYKLIQQPISLFSITDRLHKTFSQLPSVHLCSITFQWGHPPIFCSTNDICVTANFCISVTFLKPCFLLHEASASQCHLFLQPQVGTPPPHTASARAPSGPPHPHESCPAGRRPARAAQTCARRQHGLPGCEEAGTARVPSLHLHLHQAALGAGRGRGWGEACAQVPPSRGVLRFLDLKVRYLHSQWQHYHRSGEAAGTPLWRPTRNVPFRELKNQRTAQGAPGIHHAASPVAANLCDPARHAQHTRIPCGAGQVRAGRGPEAGGGVLQPQRPAPEKPGCPCRRGQPRLHTVKMWRAVAMMVPDRQVHYDFGLQNLQNGGGSRSSATLPGRRRRRWLRRRRQPISVAPAGPPRRPNQKPNPPGGARCVIMRPTWPGTSAFTKRSFAVTERIITEISCCTLSSEENEYLPRPEWQLQYEAGMTLGGKILFFLFLLLPLSPFSLIFDYWAQKEKGSSSFLRPSCVPFRELKNVSVLEGLRQGRLGGPCSCHCPRPSQARLTPVDVAGPFLCLGDPGLFPPVKSSITGGKSTCSAPGPQSLPSTPFSTYPQWVILITELGMECTLGQVGAPSPRREEDGWRGGHSRFKADVPAPQGPCWGGQPGSAPSSAPPEQSLLDDYWAQKEKISIPRTHLCLVLGVLSGHSGSRLWKFEMSYTVGGPPPHVHARPRHWKTDR

SEQ ID NO: 625 - protein, 1507 aa, Artificial seqeunce
  Heterologous polypeptide
MGQKEQIHTLQKNSERMSKQLTRSSQAVGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIRQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELDGHSYTSKVNCLLLQDGFHGCVSITGAAGRRNLSIFLFLMLCKLEFHACQWQHYHRSGEAAGTPLWRPTRNVAMMVPDRQVHYDFGLVLRFLDLKVRYLHSKIQNKNCPDVPFRELKNQRTAQGAPGIHHAASPVAANLCDPARHAQHTRIPCGAGQVRAGRGPEAGGGVLQPQRPAPEKPGCPCRRGQPRLHTVKMWRACHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVGVPGDSTRRAVRRMNTFCGASACDVSLIAMDSACEERGAAGSLISCESLYHREKQLIAMDSAIFVQGKDWGVKKFIRRDFTMPAILKLQKNCLLSLNSKMALNSEALSVVSEYEAGMTLGEKFRVGNCKHLKMTRPTEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQ

SEQ ID NO: 626 - protein, 1507 aa, Artificial seqeunce
  Heterologous polypeptide
MGQKEQIHTLQKNSERMSKQLTRSSQAVDGHSYTSKVNCLLLQDGFHGCVSITGAAGRRNLSIFLFLMLCKLEFHACVPFRELKNQRTAQGAPGIHHAASPVAANLCDPARHAQHTRIPCGAGQVRAGRGPEAGGGVLQPQRPAPEKPGCPCRRGQPRLHTVKMWRAQWQHYHRSGEAAGTPLWRPTRNKIQNKNCPDVAMMVPDRQVHYDFGLVLRFLDLKVRYLHSCHLFLQPQVGTPPPHTASARAPSGPPHPHESCPAGRRPARAAQTCARRQHGLPGCEEAGTARVPSLHLHLHQAALGAGRGRGWGEACAQVPPSRGHYKLIQQPISLFSITDRLHKTFSQLPSVHLCSITFQWGHPPIFCSTNDICVTANFCISVTFLKPCFLLHEASASQFKKFDGPCGERGGGRTARALWARGDSVLTPALDPQTPVRAPSLTRAAAAVQNLQNGGGSRSSATLPGRRRRRWLRRRRQPISVAPAGPPRRPNQKPNPPGGARCVIMRPTWPGTSAFTGMECTLGQVGAPSPRREEDGWRGGHSRFKADVPAPQGPCWGGQPGSAPSSAPPEQSLLDDYWAQKEKISIPRTHLCWKFEMSYTVGGPPPHVHARPRHWKTDRDYWAQKEKGSSSFLRPSCVPFRELKNVSVLEGLRQGRLGGPCSCHCPRPSQARLTPVDVAGPFLCLGDPGLFPPVKSSITEISCCTLSSEENEYLPRPEWQLQYEAGMTLGGKILFFLFLLLPLSPFSLIFLVLGVLSGHSGSRLKRSFAVTERIITGGKSTCSAPGPQSLPSTPFSTYPQWVILITELGNTTLQQLGEASQAPSGSLIPLRLPLLWEVRGNSKMALNSLNSIDDAQLTRIAPPRSHCCFWEVNAPFVQGKDWGLKKFIRRDFEAFQRAAGEGGPGRGGARRGARVLQSPFCRAGAGEWLGHQSLRWGMELAASRRFSWDHHSAGGPPRVPSVRSGAAQVQPKDPLPLRTLAGCLARTAHLRPGAESLPQPQLHCTIARELHQFAFDLLIKSHKMHFSLKEHPPPPCPPHVVGYGHLDTSGSSSSSSWPQPDSFAALHSSLNELGELWFQSSELSPTGAPWPSRRPTWRGTTVSPRTATSSARTCCGTKWPSSQEAALGLGSGLLRFSCGTAAIRGVPGDSTRRAVRRMNTFCGASACDVSLIAMDSACEERGAAGSLISCESLYHREKQLIAMDSAIFVQGKDWGVKKFIRRDFYEAGMTLGEKFRVGNCKHLKMTRPTMPAILKLQKNCLLSLNSKMALNSEALSVVSETEYNQKLQVNQFSESKRTALTHNQDFSIYRLCCKRGSLCHASQARSPAFPKPVRPLPAPITRITPQLGGQSDSSQPLLTTGRPQGWQDQALRHTQQASPASCATITIPIHSAALGDHSGDPGPAWDTCPPLPLTTLIPRAPPPYGDSTARSWPSRCGPLGYAYKDFLWCFPFSLVFLQEIQICCHVSCLCCICCSTRICLGCLLELFLSRALRALHVLWNGFQLHCQ

SEQ ID NO: 627 - protein, 7 aa, Artificial seqeunce
  protein tag
SHHHHHH

SEQ ID NO: 628 - DNA, 845 bp, Artificial sequence
  Promoter
ccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtga

SEQ ID NO: 629 - DNA, 227 bp, Artificial sequence
  polyA site
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcc

SEQ ID NO: 630 - DNA, 149 bp, Artificial sequence
  Promoter
gatcactaattccaaacccacccgctttttatagtaagtttttcacccataaataataaatacaataattaatttctcgtaaaagtagaaaatatattctaatttattgcacggtaaggaagtagaatcataaagaacagtgacggatc

SEQ ID NO: 631 - protein, 15 aa, Homo sapiens
VPFRELKNQRTAQGA

SEQ ID NO: 632 - protein, 15 aa, Homo sapiens
QRTAQGAPGIHHAAS

SEQ ID NO: 633 - protein, 15 aa, Homo sapiens
GIHHAASPVAANLCD

SEQ ID NO: 634 - protein, 15 aa, Homo sapiens
VAANLCDPARHAQHT

SEQ ID NO: 635 - protein, 15 aa, Homo sapiens
ARHAQHTRIPCGAGQ

SEQ ID NO: 636 - protein, 15 aa, Homo sapiens
IPCGAGQVRAGRGPE

SEQ ID NO: 637 - protein, 15 aa, Homo sapiens
RAGRGPEAGGGVLQP

SEQ ID NO: 638 - protein, 15 aa, Homo sapiens
GGGVLQPQRPAPEKP

SEQ ID NO: 639 - protein, 15 aa, Homo sapiens
RPAPEKPGCPCRRGQ

SEQ ID NO: 640 - protein, 15 aa, Homo sapiens
CPCRRGQPRLHTVKM

SEQ ID NO: 641 - protein, 14 aa, Homo sapiens
RGQPRLHTVKMWRA

SEQ ID NO: 642 - protein, 15 aa, Homo sapiens
CHLFLQPQVGTPPPH

SEQ ID NO: 643 - protein, 15 aa, Homo sapiens
VGTPPPHTASARAPS

SEQ ID NO: 644 - protein, 15 aa, Homo sapiens
ASARAPSGPPHPHES

SEQ ID NO: 645 - protein, 15 aa, Homo sapiens
PPHPHESCPAGRRPA

SEQ ID NO: 646 - protein, 15 aa, Homo sapiens
PAGRRPARAAQTCAR

SEQ ID NO: 647 - protein, 15 aa, Homo sapiens
AAQTCARRQHGLPGC

SEQ ID NO: 648 - protein, 15 aa, Homo sapiens
QHGLPGCEEAGTARV

SEQ ID NO: 649 - protein, 15 aa, Homo sapiens
EAGTARVPSLHLHLH

SEQ ID NO: 650 - protein, 15 aa, Homo sapiens
SLHLHLHQAALGAGR

SEQ ID NO: 651 - protein, 15 aa, Homo sapiens
AALGAGRGRGWGEAC

SEQ ID NO: 652 - protein, 15 aa, Homo sapiens
RGWGEACAQVPPSRG

SEQ ID NO: 653 - protein, 15 aa, Homo sapiens
HYKLIQQPISLFSIT

SEQ ID NO: 654 - protein, 15 aa, Homo sapiens
ISLFSITDRLHKTFS

SEQ ID NO: 655 - protein, 15 aa, Homo sapiens
RLHKTFSQLPSVHLC

SEQ ID NO: 656 - protein, 15 aa, Homo sapiens
LPSVHLCSITFQWGH

SEQ ID NO: 657 - protein, 15 aa, Homo sapiens
ITFQWGHPPIFCSTN

SEQ ID NO: 658 - protein, 15 aa, Homo sapiens
PIFCSTNDICVTANF

SEQ ID NO: 659 - protein, 15 aa, Homo sapiens
ICVTANFCISVTFLK

SEQ ID NO: 660 - protein, 15 aa, Homo sapiens
ISVTFLKPCFLLHEA

SEQ ID NO: 661 - protein, 11 aa, Homo sapiens
CFLLHEASASQ

SEQ ID NO: 662 - protein, 15 aa, Homo sapiens
RTALTHNQDFSIYRL

SEQ ID NO: 663 - protein, 15 aa, Homo sapiens
DFSIYRLCCKRGSLC

SEQ ID NO: 664 - protein, 15 aa, Homo sapiens
CKRGSLCHASQARSP

SEQ ID NO: 665 - protein, 15 aa, Homo sapiens
ASQARSPAFPKPVRP

SEQ ID NO: 666 - protein, 15 aa, Homo sapiens
FPKPVRPLPAPITRI

SEQ ID NO: 667 - protein, 15 aa, Homo sapiens
PAPITRITPQLGGQS

SEQ ID NO: 668 - protein, 15 aa, Homo sapiens
PQLGGQSDSSQPLLT

SEQ ID NO: 669 - protein, 15 aa, Homo sapiens
SSQPLLTTGRPQGWQ

SEQ ID NO: 670 - protein, 15 aa, Homo sapiens
GRPQGWQDQALRHTQ

SEQ ID NO: 671 - protein, 15 aa, Homo sapiens
QALRHTQQASPASCA

SEQ ID NO: 672 - protein, 15 aa, Homo sapiens
ASPASCATITIPIHS

SEQ ID NO: 673 - protein, 15 aa, Homo sapiens
ITIPIHSAALGDHSG

SEQ ID NO: 674 - protein, 15 aa, Homo sapiens
ALGDHSGDPGPAWDT

SEQ ID NO: 675 - protein, 15 aa, Homo sapiens
PGPAWDTCPPLPLTT

SEQ ID NO: 676 - protein, 15 aa, Homo sapiens
PPLPLTTLIPRAPPP

SEQ ID NO: 677 - protein, 15 aa, Homo sapiens
IPRAPPPYGDSTARS

SEQ ID NO: 678 - protein, 16 aa, Homo sapiens
GDSTARSWPSRCGPLG

SEQ ID NO: 679 - protein, 15 aa, Homo sapiens
YAYKDFLWCFPFSLV

SEQ ID NO: 680 - protein, 15 aa, Homo sapiens
CFPFSLVFLQEIQIC

SEQ ID NO: 681 - protein, 15 aa, Homo sapiens
LQEIQICCHVSCLCC

SEQ ID NO: 682 - protein, 15 aa, Homo sapiens
HVSCLCCICCSTRIC

SEQ ID NO: 683 - protein, 15 aa, Homo sapiens
CCSTRICLGCLLELF

SEQ ID NO: 684 - protein, 15 aa, Homo sapiens
GCLLELFLSRALRAL

SEQ ID NO: 685 - protein, 15 aa, Homo sapiens
SRALRALHVLWNGFQ

SEQ ID NO: 686 - protein, 11 aa, Homo sapiens
VLWNGFQLHCQ

SEQ ID NO: 687 - protein, 15 aa, Homo sapiens
YEAGMTLGEKFRVGN

SEQ ID NO: 688 - protein, 16 aa, Homo sapiens
EKFRVGNCKHLKMTRP

SEQ ID NO: 689 - protein, 15 aa, Homo sapiens
WGMELAASRRFSWDH

SEQ ID NO: 690 - protein, 15 aa, Homo sapiens
RRFSWDHHSAGGPPR

SEQ ID NO: 691 - protein, 15 aa, Homo sapiens
SAGGPPRVPSVRSGA

SEQ ID NO: 692 - protein, 15 aa, Homo sapiens
PSVRSGAAQVQPKDP

SEQ ID NO: 693 - protein, 15 aa, Homo sapiens
QVQPKDPLPLRTLAG

SEQ ID NO: 694 - protein, 15 aa, Homo sapiens
PLRTLAGCLARTAHL

SEQ ID NO: 695 - protein, 15 aa, Homo sapiens
LARTAHLRPGAESLP

SEQ ID NO: 696 - protein, 14 aa, Homo sapiens
PGAESLPQPQLHCT

SEQ ID NO: 697 - protein, 15 aa, Homo sapiens
NSKMALNSLNSIDDA

SEQ ID NO: 698 - protein, 15 aa, Homo sapiens
LNSIDDAQLTRIAPP

SEQ ID NO: 699 - protein, 15 aa, Homo sapiens
LTRIAPPRSHCCFWE

SEQ ID NO: 700 - protein, 15 aa, Homo sapiens
APPRSHCCFWEVNAP

SEQ ID NO: 701 - protein, 15 aa, Homo sapiens
LWFQSSELSPTGAPW

SEQ ID NO: 702 - protein, 15 aa, Homo sapiens
SPTGAPWPSRRPTWR

SEQ ID NO: 703 - protein, 15 aa, Homo sapiens
SRRPTWRGTTVSPRT

SEQ ID NO: 704 - protein, 15 aa, Homo sapiens
TTVSPRTATSSARTC

SEQ ID NO: 705 - protein, 15 aa, Homo sapiens
TSSARTCCGTKWPSS

SEQ ID NO: 706 - protein, 15 aa, Homo sapiens
GTKWPSSQEAALGLG

SEQ ID NO: 707 - protein, 15 aa, Homo sapiens
EAALGLGSGLLRFSC

SEQ ID NO: 708 - protein, 13 aa, Homo sapiens
GLLRFSCGTAAIR

SEQ ID NO: 709 - protein, 15 aa, Homo sapiens
QNLQNGGGSRSSATL

SEQ ID NO: 710 - protein, 15 aa, Homo sapiens
QWQHYHRSGEAAGTP

SEQ ID NO: 711 - protein, 14 aa, Homo sapiens
GEAAGTPLWRPTRN

SEQ ID NO: 712 - protein, 16 aa, Homo sapiens
TEYNQKLQVNQFSESK

SEQ ID NO: 713 - DNA, 32767 bp, Artificial sequence
  recombinant GAd20
catcatcaataatataccttattttggattgaggccaatatgataatgaggtgggcggggcgaggcggggcgggtgacgtaggacgcgcgagtagggttgggaggtgtggcggaagtgtggcatttgcaagtgggaggagctgacatgcaatcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcgccgtcatctgacgggccgccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctccctatcagtgatagagatctccctatcagtgatagagatcgtcgacgagctcgtttagtgaaccgtcagatcgcctggagacgccatccacgctgttttgacctccatagaagacaccgggaccgatccagcctccgcggccgggaacggtgcattggaacgcggattccccgtgccaagagtgagatcttccgtttatctaggtaccagatatcagaattcggatcccgcgacttcgccgccatgggccagaaagagcagatccacacactgcagaaaaacagcgagcggatgagcaagcagctgaccagatcttctcaggccgtgcagaacctgcagaacggcggaggctctagaagctctgctacacttcctggcaggcggcggagaagatggctgagaagaaggcggcagcctatctctgtggctcctgctggacctcctagacggcccaaccagaagcctaatcctcctggcggagccagatgcgtgatcatgaggcctacatggcctggcaccagcgccttcaccaagagaagctttgccgtgaccgagcggatcatcgactattgggctcaaaaagagaagggcagcagcagcttcctgcggcctagctgtgattattgggcccagaaagaaaagatcagcatccccagaacacacctgtgcctggtgctgggagtgctgtctggacactctggcagcagactgtatgaggccggcatgacactcggcggcaagatcctgttcttcctgttcctgctgctccctctgagccccttcagcctgatcttcaccgagatcagctgctgcaccctgagcagcgaggaaaacgagtacctgcctagacctgagtggcagctgcaggtccccttcagagagctgaagaacgtttccgtgctggaaggcctgagacagggcagacttggcggcccttgtagctgtcactgccccagacctagtcaggccagactgacacctgtggatgtggccggacctttcctgtgtctgggagatcctggcctgtttccacctgtgaagtccagcatcacaggcggcaagtccacatgttctgcccctggacctcagagcctgcctagcacacccttcagcacataccctcagtgggtcatcctgatcaccgaactcggcatggaatgcaccctgggacaagtgggagccccatctcctagaagagaagaggatggctggcgcggaggccactctagattcaaagctgatgtgcccgctcctcagggcccttgttggggaggacaacctggatctgccccatcttctgccccacctgaacagtccctgctggattggaagttcgagatgagctacaccgtcggcggacctccacctcatgttcatgccagacctcggcactggaaaaccgacagagatggccacagctacaccagcaaagtgaactgcctcctgctgcaggatggcttccacggctgtgtgtctattactggcgccgctggcagacggaacctgagcatctttctgtttctgatgctgtgcaagctcgagttccacgcctgcaagatccagaacaagaactgccccgacttcaagaagttcgacggcccttgcggagaaagaggcggaggcagaacagctagagccctttgggctagaggcgacagcgttctgacaccagctctggaccctcagacacctgttagggcccctagcctgacaagagctgccgccgctgtgcactacaagctgatccagcagccaatcagcctgttcagcatcaccgaccggctgcacaagacattcagccagctgccaagcgtgcacctgtgctccatcaccttccagtggggacaccctcctatcttttgctccaccaacgacatctgcgtgaccgccaacttctgtatcagcgtgaccttcctgaagccttgctttctgctgcacgaggccagcgcctctcagtgccacttgtttctgcagccccaagtgggcacacctcctccacatacagcctctgctagagcacctagcggccctccacatcctcacgaatcttgtcctgccggaagaaggcctgccagagccgctcaaacatgtgccagacgacagcacggactgcctggatgtgaagaggctggaacagccagagtgcctagcctgcacctccatctgcatcaggctgctcttggagccggaagaggtagaggatggggcgaagcttgtgctcaggtgccaccttctagaggcgtgctgagattcctggacctgaaagtgcgctacctgcacagccagtggcagcactatcacagatctggcgaagccgccggaacacccctttggaggccaacaagaaacgtgcccttccgggaactgaagaaccagagaacagctcagggcgctcctggaatccaccatgctgcttctccagtggccgccaacctgtgtgatcctgccagacatgcccagcacaccaggattccttgtggcgctggacaagtgcgcgctggaagaggacctgaagcaggcggaggtgttctgcaacctcaaagacccgctcctgagaagcctggctgcccttgcagaagaggacagcctagactgcacaccgtgaaaatgtggcgagccgtggccatgatggtgcccgatagacaggtccactacgactttggactgggcgtgccaggcgatagcactcggagagccgtcagacggatgaacaccttttacgaagccgggatgaccctgggcgagaagttcagagtgggcaactgcaagcacctgaagatgacccggcctaacagcaagatggccctgaatagcgaggccctgtctgtggtgtctgaatgtggcgcctctgcctgtgacgtgtccctgatcgctatggactccgcctttgtgcagggcaaagactggggcgtgaagaagttcatccggcgggacttctacgcctacaaggacttcctgtggtgcttccccttctctctggtgttcctgcaagagatccagatctgctgtcatgtgtcctgcctgtgctgcatctgctgtagcaccagaatctgcctgggctgtctgctggaactgttcctgagcagagccctgagagcactgcacgtgctgtggaacggattccagctgcactgccagaccgagtacaaccagaaactgcaagtgaaccagttcagcgagagcaagagcctgtaccaccgggaaaagcagctcattgccatggacagcgccatctgcgaagagagaggcgccgcaggatctctgatctcctgcgaaacaatgcccgccatcctgaagctgcagaagaattgcctcctaagcctgcgaaccgctctgacacacaaccaggacttcagcatctacagactgtgttgcaagcggggctccctgtgccatgcaagccaagctagaagccccgcctttcctaaacctgtgcgacctctgccagctccaatcaccagaattacccctcagctcggcggccagagcgattcatctcaacctctgctgaccaccggcagacctcaaggctggcaagaccaagctctgagacacacccagcaggctagccctgcctcttgtgccaccatcacaatccccatccactctgccgctctgggcgatcattctggcgatcctggaccagcctgggacacatgtcctccactgccactcacaacactgatccctagggctcctccaccttacggcgattctaccgctagaagctggcccagcagatgtggaccactcggaggcaacacaaccctccagcaactgggagaagcctctcaggctcctagcggctctctgatccctctcagactgcctctcctgtgggaagttcggggccagcctgattcttttgccgcactgcacagctccctgaacgagctgggagagatcgctagagagctgcaccagttcgccttcgacctgctgatcaagagccacttcgtgcaaggcaaggattggggcctcaaaaagtttatccgcagagacttctggggcatggaactggccgccagcagaagattcagctgggatcatcatagcgcaggcggcccacctagagtgccatctgttagaagcggagctgcccaggtgcagcctaaagatcctctgccactgagaacactggccggctgccttgctagaacagcccatcttagacctggcgccgagtctctgcctcagccacaactgcactgtaccctgtggttccagtccagcgagctgtctcctactggtgccccttggccatctagacgccctacttggagaggcaccaccgtgtcaccaagaaccgccacaagcagcgccagaacctgttgtggcacaaagtggccctccagccaagaagccgctctcggacttggaagcggactgctgaggttctcttgtggaaccgccgccattcggaagatgcactttagcctgaaagaacaccctccaccaccttgtcctccagaggctttccaaagagctgctggcgaaggcggacctggtagaggtggtgctagaagaggtgctagggtgctgcagagcccattctgtagagcaggcgcaggcgaatggctgggccatcagagtctgagacatgtcgtcggctacggccacctggatacaagcggaagcagctctagctccagctggcctaactcaaaaatggctctgaacagcctgaactccatcgacgacgcccagctgacaagaatcgcccctcctagatctcactgctgcttttgggaagtgaacgccccaagccatcaccatcaccaccattagtaaaggcgcgcctagcggccgcgatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggccgggccgcgatcgcgcttaggcctgaccatctggtgctggcctgcaccagggccgagtttgggtctagcgatgaggataccgattgaggtgggtaaggtgggcgtggctagcagggtgggcgtgtataaattgggggtctaaggggtctctctgtttgtcttgcaacagccgccgccatgagcgacaccggcaacagctttgatggaagcatctttagtccctatctgacagtgcgcatgcctcactgggccggagtgcgtcagaatgtgatgggttccaacgtggatggacgtcccgttctgccttcaaattcgtctactatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgactgctctgctgcttaaactggaagacttgacccgggagctgggtcaactgacccagcaggtttccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattttttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgcttagctgggaggggtgcatccggggggatatgatgtgcatcttggactggatttttaggttggctatgttcccgcccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaacgtttctggcatcgctcacatcgtagttatgttccagggtgaggtcatcataggacatctttacgaatcgggggcgaagggtcccggactgggggatgatggtaccctcgggccccggggcgtagttcccctcacagatctgcatctcccaggctttcatttcagagggagggatcatatccacctgcggggcgatgaaaaagacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttgagcatatccctgacgtggatgttctccctgaccagttccgccagaaggcgctcgccgcccagcgaaagcagctcttgcaaggaagcaaaatttttcagcggtttcaggccatcggccgtgggcatgtttttcagcgtctgggtcagcagctccagcctgtcccagagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcactggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggccgagcagaccgtctcgcattccaccagccaagtgagttccgggcggtcagggtcaaaaaccaggttgcccccatgctttttgatgcgtttcttaccttggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccaacgggggggtataaaagggggtgggtgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttatcaagcttggtggcgaatgacccgtagagggcgttggagagcagcttggcgatggagcgcagggtctggtttttgtcgcggtcggctcgctccttggccgcgatgttgagttgcacgtactcgcgggccacgcacttccactcggggaacacggtggtgcgctcgtctgggatcaggcgcaccctccagccgcggttgtgcagggtgaccatgtcgacgctggtggcgacctcaccgcgcagacgctcgttggtccagcagaggcggccgcccttgcgcgagcagaaggggggtagggggtccagctggtcctcgtttggggggtccgcgtcgatggtaaagaccccggggagcaggcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggataccgaggtaggtggggtagcagcgccccccgcggatgctggcgcgcacgtagtcatagagctcgtgggagggggccagcatgttgggcccgaggttggtgcgctgggggcgctcggcgcggaagacgatctgcctgaagatggcgtgggagttggaggagatggtgggccgctggaagacgttgaagcttgcttcttgcaagcccacggagtccctgacgaaggaggcgtaggactcgcgcagcttgtgcaccagctcggcggtgacctggacgtcgagcgcacagtagtcgagggtctcgcggatgatgtcatacctatcctcccccttctttttccacagctcgcggttgaggacgaactcttcgcggtctttccagtactcttggaggggaaacccgtccgtgtccgaacggtaagagcctagcatgtagaactggttgacggcctggtaggggcagcagcccttctccacgggcagcgcgtaggcctgcgccgccttgcggagggaggtgtgggtgagggcgaaagtgtccctgaccatgactttgaggtattgatgtctgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtgtcccacgatgtagagctccaggaagcggggctggcccttgatggaggggagctttttaagttcctcgtaggtaagctcctcgggcgattccaggccgtgctcctccagggcccagtcttgcaagtgagggttggccgccaggaaggatcgccagaggtcgcgggccatgagggtctgcaggcggtcgcggaaggttctgaactgccgccccacggccattttttcgggggtgatgcagtagaaggtgagggggtctttctcccaggggtcccatctgagctctcgggcgaggtcgcgcgcggcagcgaccagagcctcgtcgccccccagtttcatgaccagcatgaagggcacgagttgcttgccaaaggctcccatccaagtgtaggtttctacatcgtaggtgacaaagaggcgctccgtgcgaggatgagagccgattgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttttactttggttgtctggccgccagcatctgtctcctggagggcgatggtggaacagaccaccacgccgcgagagccgcaggtccagatctcggcgctcggcgggcggagtttgatgacgacatcgcgcacattggagctgtccatggtctccagctcccgcggcggcaggtcagccgggagttccctggaggttcacctcgcagagacgggtcaaggcgcggacagtgttgagatggtatctgatttcaaggggcatgttggaggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgttcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatttctgccatgaactgctcgatctcttcctcctggagatctcctcgtccggcgcgctccacggtggccgccaggtcgttggagatgcgacccatgagctgcgagaaggcgttgagtccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagaacggatgagctcggcgacagtgtcgcgcacctcgcgctcgaaggccacggggggcgcttcttcctcttccacctcttcttccatgattgcttcttcttcttcctcagccgggacgggagggggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatttcgccgcggggcgggcggccgtgaggtagcgagacggcgctgactatgcatcttaacaattgctgtgtaggtacgccgccaagggacctgattgagtccagatccaccggatccgaaaacctttggaggaaagcgtctatccagtcgcagtcgcaaggtaggctgagcaccgtggcgggcgggggcgggtcgggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtaatcttgcatgagtctttccaccggcacttcttctccttcctcttcttcatctcgccggtggtttctcgcgccgcccatgcgcgtgaccccaaagcccctgagcggctgcagcagggccaggtcggcgaccacgcgctcggccaagatggcctgctgtacctgagtgagggtcctctcgaagtcatccatgtccacgaagcggtggtaggcacccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgcctgcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcagccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgtgggctgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcctctccccgccccggtcaccacggccgcggcggccgtgtccggtgcggggggcgcgctggagtcagatgagccaccgcggcggcgacctaggcagtatctggacttggaagagggcgagggactggcgcggctgggggcgagctctccagagcgccacccgcgggtgcagttgaaaagggacgcgcgtgaggcgtacctgccgcggcaaaacctgtttcgcgaccgcgggggcgaggagcccgaggagatgcgggactgcaggttccaagcggggcgcgagctgcgccgcggcttggacagacagcgcctgctgcgcgaggaggactttgagcccgacacgcagacgggcatcagccccgcgcgcgcgcacgtggccgcggccgacctggtgaccgcctacgagcagacggtgaaccaggagcgcaacttccaaaaaagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccattaactattctatgctgagcctgggcaagttctacgctcgcaagatctacaagaccccctacgtgcccatagacaaggaggtgaagatagacagcttctacatgcgcatggcgctgaaggtgctaaccctgagcgacgacctgggagtgtaccgcaacgagcgcatccacaaggccgtgagcgccagccggcggcgcgagctgagcgaccgcgaactgatgcacagtctgcagcgcgcgctgaccggcgcgggcgagggcgacagggaggtcgagtcctactttgacatgggggccgacctgcactggcagccgagccgccgcgccctggaagcggcgggggcgtacggcggccccctggcggccgatgacgaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgggtcgcatcatggccctgaccgcgcgcaaccccgaggccttcaggcagcagcctcaggctaaccggctggcggccatcttggaagcggtagtgcccgcgcgctccaaccccacccacgagaaggtgctggccatagtcaacgcgctggcggagagcagggccatccgggcagacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggcaacctgggctcgctggtggcgctaaacgccttccttagcacccagccggccaacgtaccgcgggggcaggaggactacaccaacttcttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaggagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcttcccagcggccgttcatcaaccgcctgatggactacttgcatcgggcggcggccgtgaaccccgagtacttcaccaatgccattctgaatccccactggatgccccctccgggtttctacaacggggacttcgaggtgcctgaggtcaacgatgggttcctctgggatgacatggatgacagtgtgttctcccccaacccgctgcgcgccgcgtctctgcgattgaaggagggctctgacagggaaggaccaaggagtctggcctcctccctggctctgggggcggtgggcgccacgggcgcggcggcgcggggcagcagccccttccccagcctggcggactctctgaatagcgggcgggtgagcaggccccgcttgctaggcgaggaggagtatctgaacaactccctgctgcagcccgtgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctagacagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagagaaaaataaaaactcaccaaggccatggcgacgagcgttggttttttgttcccttccttagtatgcggcgcgcggcgatgttcgaggaggggcctcccccctcttacgagagcgcgatgggaatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagtacccagaccataaacctggacaacaggtcgaactggggcggcgacctgaagactatcctgcacaccaatatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggagagcgatatcggggtcaagtttgacaccagaaacttccgtctgggctgggaccctgtgaccgggctggtcatgccgggggtctacaccaacgaggcctttcatcccgatatagtgctcctgcccggctgtggggtggacttcacccagagccggctgagcaacctgctgggcgttcgcaagcggcaacctttccaggagggtttcaagatcacctatgaggatctggaggggggcaacattcccgcgctccttgatctggacgcctacgaggagagcttgaaacccgaggagagcgctggcgacagcggcgagagtggcgaggagcaagccggcggcggcggcagcgcgtcggtagaaaacgaaagtactcccgcagtggcggcggacgctgcggaggtcgagccggaggccatgcagcaggacgcagaggagggcgcgcaggaggacatgaacaatggggagatcaggggcgacactttcgccacccggggcgaagaaaaagaggcagaggcggcggcggcgacggcggaagccgaaaccgaggcagaggcagagcccgagaccgaagttatggaagacatgaatgatggagaacgtaggggtgacacgtttgccacccggggcgaagagaaggcggcggaggcagaagccgcggctgaggaggcggctgcggctgcggccaaggctgaggctgcggctgaggctaaggtcgaagccgatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcattgagggcagcacctttacccaataccgcagctggtacctggcttacaactacggcgacccggtcaagggggtgcgctcgtggaccctgctctgcacgccggacgtcacctgcggctccgagcagatgtactggtcgctgccaaacatgatgcaagacccggtgaccttccgttccacgcggcaggttagcaactttccggtggtgggcgccgaactgctgccagtacactccaagagtttttacaacgagcaggccgtctactcccagctgatccgccaggccacctctctgacccacgtgttcaatcgctttcccgagaaccagattttggcgcgcccgccggcccccaccatcaccaccgtcagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatccacccacacgctccaaaatcatgtccgtactcatctcgcccagcaacaacaccggctgggggctgcgcgcacccagcaagatgtttggaggggcaaggaagcgctccgaccagcaccccgtgcgcgtgcgcggccactaccgcgcgccctggggtgcgcacaagcgcgggcgcacagggcgcaccactgtggatgatgtcattgactccgtagtggagcaggcgcgccactacacacccggcgcgccgaccgcctccgccgtgtccaccgtggaccaggcgatcgaaagcgtggtacagggggcgcggcactatgccaaccttaaaagtcgccgccgccgcgtggcgcgccgccatcgccggagaccccgggctactgccgccgcgcgccttaccaaggctctgctcaagcgcgccaggcgaactggccaccgggccgccatgagggccgcacggcgggctgccgctgccgcgagcgccgtggccccgcgggcacgaaggcgcgcggccgctgccgccgccgccgccatttccagcttggcctcgacgcggcgcggtaacatatactgggtgcgcgactcggtgagcggcacacgtgtgcccgtgcgctttcgccccccacggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggaggattacaagccccgcaagctaaagcgggtcaaaaagaaaaagaaagatgatgacgttgacgaggcggtggagtttgtccgccgcatggcgcccaggcgccctgtgcagtggaagggtcggcgcgtgcagcgagtcctgcgccccggcaccgcggtggtctttacgcccggcgagcgttccacgcgcactttcaagcgggtgtacgatgaggtgtacggcgacgaggatctgttggagcaggccaaccatcgatttggggagtttgcatatgggaaacggcctcgcgagagtctaaaagaggacctgctggcgctaccgctggacgagggcaatcccaccccgagtctgaagccggtgaccctgcaacaggtgctgcctttgagcgcgcccagcgagcagaagcgagggttaaagcgcgagggcggggacctggcacccaccgtgcagttgatggtgcccaagcggcagaagctggaggacgtgctggagaaaatgaaagtagagcccgggatccagcccgagatcaaggtccgccctatcaagcaggtggcgcccggcgtgggagtccagaccgtggacgttaggattcccacggaggagatggaaacccaaaccgccactccctcttcggcagcaagcgccaccaccggcgccgcttcggtagaggtgcagacggacccctggctacccgccgccactatcgccgtcgccgccgccccccgttcgcgcggacgcaagagaaattatccagcggccagcgcgcttatgccccagtatgcgctgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgccttcgcttcccggtgccgggataccgaggaagaactcaccgccgcaggggcatggcgggcagcggtctccgcggcggccgtcgccatcgccggcgcgcaaagagcaggcgcatgcgcggcggtgtgttgcccctgctggtcccgctactcgccgcggcgatcggcgccgtgcccgggatcgcctccgtggccctgcaggcgtcccagaaacattgactcttgcaaccttgcaagcttgcatttttggaggaaaaaataaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggtcagatgctgagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtctcccgagggcaaaggcgaaaagcgcccgcggcccgacagggaagagaccctggtgtcacacaccgaggagccgccctcttacgaggaggcagtcaaggccggcctgcccaccactcgccccatagctcccatggccaccggtgtggtgggtcacaggcaacacacccccgcaacactagatctgcccccgccgtccgagccgactcgccagccaaaggcggtgacggtgtccgctccctccacttccgccgccaacagagtgcctctgcgccgcgctgcgagcggcccccgggcctcgcgagtcagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcttactcttacaaggcgcggttcacgctggccgtgggcgacaaccgcgtgctggacatggcctccacttactttgacatccggggggtgctggacaggggccccacttttaagccctactcgggcactgcctacaaccccctggcccccaagggcgcccccaattcttgtgagtgggaacaagaggaaaatcaggtggtcgctgcagatgatgaacttgaagatgaagaagcgcaagcacaagaggaagcccctgtgaaaaaaattcatgtatatgctcaggcgcctctttctggcgaaaagatttccaaggatggtatccaaataggtactgaagtcgtaggagatacatctaaggacacttttgcagataaaacattccaacccgaacctcagataggcgagtctcagtggaacgaggctgatgccacagcagcaggaggtagagttttgaaaaagactacccctatgagaccttgctatggatcctatgccaggcctaccaatgccaacgggggtcaaggaattatggttgccaatgaacaaggagtgttggagtctaaagtagaaatgcaatttttctctaacaccacaacccttaatgcgcgggatggaaccggcaatcccgaaccaaaggtggtgttgtacagcgaagatgtccacttggaatctcccgatactcatctgtcttacaagcccaaaaaggatgatgttaatgccaaaatcatgttgggtcagcaagccatgcccaacagacccaacctcattggatttagagataatttcattgggcttatgttttacaacagcaccggtaacatgggagtgctggcgggtcaggcctctcagttgaatgctgtggtggacttgcaggatagaaacacagaactgtcatatcagcttctgcttgattcaattggggatagaaccagatacttctccatgtggaaccaggcagtggatagctatgatccagatgtcagaattattgaaaaccatgggactgaggatgaactgcccaactactgcttccctttgggcggcataggagttactgatacttatcaagggataaaaaataccaatggcaatggtcagtggaccaaagatgatcagttcgcggaccgcaacgaaataggggtgggaaacaacttcgccatggagatcaacatccaggccaacctttggagaaacttcctctatgcaaacgtggggctctacctgccagacaagctcaagtacaaccccaccaacgtggacatctctgacaaccccaacacctatgactacatgaacaagcgggtggtggcccctggcctggtggactgctttgtcaatgtgggagccaggtggtccctggactacatggacaacgtcaaccccttcaaccaccaccgcaatgcgggtctgcgctaccgctccatgatcctgggcaacgggcgctatgtgccctttcacatccaggtaccccagaagttctttgccatcaagaacctcctgctcctgcccggctcctacacctacgagtggaacttcaggaaggatgtgaacatggtcctacagagctctctgggcaatgaccttagggtggatggggccagcatcaagtttgacagcatcaccctctatgctacatttttccccatggcccacaacaccgcctccacgcttgaggccatgctgagaaacgacaccaacgaccagtcctttaatgactacctctctggggccaacatgctctacccaatcccagccaaggccaccaacgtgcccatctccatcccctctcgcaactgggccgcctttagaggctgggcctttacccgccttaagaccaaggagaccccctccctgggctcgggttttgatccctactttgtttactcgggatccatcccctacctggatggcaccttctacctcaaccacactttcaagaagatatccatcatgtatgactcctccgtcagctggccgggcaacgaccgcttgctcacccccaatgagttcgaggtcaagcgcgccgtggacggcgagggctacaacgtggcccagtgcaacatgaccaaggactggttcctggtgcagatgctggccaactacaacataggctaccagggcttttacatcccagagagctacaaggacaggatgtactccttcttcagaaatttccaacccatgagccgacaggtggtggacgagaccaattacaaggactatcaagccattggcatcacccaccagcacaacaactcgggtttcgtgggctacctggcgcccaccatgcgcgagggtcaggcctaccccgccaacttcccctaccccttgataggcaagaccgcggtcgacagcgtcacccagaaaaagttcctctgcgaccgcaccctctggcgcatccccttctctagcaacttcatgtccatgggtgcgctcacggacctgggccaaaacctgctttatgccaactctgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgtacgcccttctcagccggcaacgccaccacctaaggagacagcgccgccgccgcctgcatgacgggttccaccgagcaagagctcagggccattgccagagacctgggatgcggaccctattttttgggcacctatgacaaacgcttcccgggctttatctcccgagacaagctcgcctgcgccattgtcaacacggccgcgcgcgagaccgggggcgtgcactggctggcctttggctgggacccgcgctccaaaacttgctacctctttgacccctttggcttctccgatcagcgcctcaggcagatttatgagtttgagtacgaggggctgctgcgccgcagcgcgctcgcctcctcgcccgaccgctgcatcacccttgagaagtccaccgaaaccgtgcaggggccccactcggccgcctgcggtctcttctgttgcatgtttttgcacgcctttgtgcactggcctcagagtcccatggattgcaaccccaccatgaacttgctaaagggagtgcccaacgccatgctccagagcccccaggtccagcccaccctgcgccgcaaccaggaacagctttaccgcttcctggagcgccactccccctacttccgcagccacagcgcgcgcatccggggggccacctctttttgccacttgcaagaaaacatgcaagacggaaaatgatgtacagcatgcttttaataaatgtaaagactgtgcactttaattatacacgggctctttctggttatttattcaacaccgccgtcgccatttagaaatcgaaagggttctgccgtgcgtcgccgtgcgccacgggcagagacacgttgcgatactggaagcggctcgcccacttgaactcgggcaccaccatgcggggcagtggttcctcggggaagttctcgctccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattattcacgctggccagcaggctctcgtcgctgatcatgtcgctgtccagatcctccgcgttgctcagggcgaatggggtcatcttgcagacctgcctgcccaggaaaggcgggagcccaggcttgccgttgcagtcgcagcgcaggggcattagcaggtgcccacggcccgactgcgcctgcgggtacaacgcgcgcatgaaggcttcgatctgcctaaaagccacctgggtcttggctccctccgaaaagaacatcccacaggacttgctggagaactggttcgcgggacagctggcatcgtgcaggcagcagcgcgcgtcagtgttggcaatctgcaccacgttgcgaccccaccggtttttcactatcttggccttggaagcctgctcctttagcgcgcgctggccgttctcgctggtcacatccatctctatcacctgttccttgttgatcatgtttgtcccgtgcagacactttaggtcgccctccgtctgggtgcagcggtgctcccacagcgcgcaaccggtgggctcccaattcttgtgggtcacccccgcgtaggcctgcaggtaggcctgcaggaagcgccccatcatggtcataaaggtcttctggctcgtaaaggtcagctgcaggccgcgatgctcttcgttcagccaggtcttgcagatggcggccagcgcctcggtctgctcgggcagcatcttaaaatttgtcttcaggtcgttatccacgtggtacttgtccatcatggcacgcgccgcctccatgcccttctcccaggcggacaccatgggcaggcttagggggtttatcacttccagcggcgaggacaccgtactttcgatttcttcttcctccccctcttcccggcgcgcgcccccgctgttgcgcgctcttaccgcctgcaccaaggggtcgtcttcaggcaagcgccgcaccgagcgcttgccgcccttgacctgcttgatcagtaccggcgggttgctgaagcccaccatggtcagcgccgcctgctcttcttcgtcttcgctgtctaccactatttctggggaggggcttctccgctctgcggcaaaggcggcggatcgcttcttttttttcttgggagccgccgcgatggagtccgccacggcgaccgaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgcgctggtcttggtcccgactggccattgtatcctcctcctcctaggcagagagacataaggagtctatcatgcaagtcgagaaggaggagagcttaaccaccccctcagagaccgccgatgcgcccgccgtcgccgtcgcccccgctaccgccgacgcgcccgccacaccgagcgacacccccacggacccccccgccgacgcacccctgttcgaggaagcggccgtggagcaggacccgggctttgtctcggcagaggaggatttgcaagaggaggagaataaggaggagaagccctcagtgccaaaagatcataaagagcaagacgagcacgacgcagacgcacaccagggtgaagtcgggcggggggacggagggcatggcggcgccgactacctagacgaaggaaacgacgtgctcttgaagcacctgcatcgtcagtgcgccatcgtctgcgacgctctgcaggagcgcagcgaggtgcccctcagcgtggcggaggtcagccgcgcctacgagctcagcctcttttccccccgggtgcccccccgccgccgcgaaaacggcacatgcgagcccaacccgcgcctcaacttctaccccgcctttgtggtgcccgaggtcctggccacctatcacatcttctttcaaaattgcaagatccccatctcgtgccgcgccaaccgtagccgcgccgataagatgctggccctgcgccagggcgaccacatacctgatatcgccgctttggaagatgtgccaaagatcttcgagggtctggggcgcaacgagaagcgggcagcaaactctctgcaacaggaaaacagcgaaaatgagagtcacactggagcgctggtggagctggagggcgacaacgcccgcctggcggtgctcaagcgcagcatcgaggtcacccactttgcctaccccgcgctcaacctgccccccaaagtcatgaacgcggtcatggacgggctgatcatgcgccgcggccggcccctcgctccagatgcaaacttgcatgaggagaccgaggacggtcagcccgtggtcagcgacgagcagctgacgcgctggctggagagcgcggaccccgccgaactggaggagcggcgcaagatgatgatggccgcggtgctggtcaccgtagagctggagtgtctgcagcgcttcttcggtgaccccgagatgcagagaaaggtcgaggagaccctacactacaccttccgccagggctacgtgcgccaggcttgcaagatctccaacgtggagctcagcaacctggtgtcctacctgggcatcttgcatgaaaaccgccttgggcagagcgtgctacactccaccctgcgcggggaggcgcgccgcgactacgtgcgcgactgcgtttacctcttcctctgctacacctggcagacggccatgggggtctggcagcagtgcctggaggagcgcaacctcaaggagctggagaagcttctgcagcgcgcgctcaaagacctctggacgggcttcaacgagcgctcggtggccgccgcgctagccgacctcatcttccccgagcgcctgctcaaaaccctccagcaggggctgcccgacttcaccagccaaagcatgttgcaaaattttaggaactttatcctggagcgttctggcatcctacccgccacctgctgcgccctgcccagcgactttgtccccctcgtgtaccgcgagtgccccccgccgctgtggggccactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgaaatcaggttttacgaggaccaatcccgcccgcccaaggcggagctgaccgcctgcgtcatcacccagggcgagatcctaggccaattgcaagccatccaaaaagcccgccaagagtttttgctgaagaggggtcggggggtgtatctggacccccagtcgggtgaggagctcaacccggttcccccgctgccaccgccgcgggaccttgcttcccaggataagcatcgccatggctcccagaaagaagcagcagcggccgccgctgccgccgccccacatgctggaggaagaggaggaatactgggacagtcaggcagaggaggtttcggacgaggaggagccggagacggagatggaagagtgggaggaggacagcttagacgaggaggcttccgaagccgaagaggcaggcgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagaggcggccagcggcggcggcgcccgtttcggtgcctaggaagacccagggcaagacttcagccaagaaactcgcggcgaccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgacatccgcacccatcgaaaccaaatattggtgaagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagtttatcccgaactttgacgccgcgagggactcggtggacggctacgactgaatgtcgggtggacccggtgcagagcaacttcgcctgaagcaccttgaccactgccgccgccctcagtgctttgcccgctgtcagaccggtgagttccagtacttttccctgcccgactcgcacccggacggcccggcgcacggggtgcgctttttcatcccgagtcaggtccgctctaccctaatcagggagttcaccgcccgtcccctactggcggagttggaaaaggggccttctatcctaaccattgcctgcatttgctctaaccctggattacaccaagatctttgctgtcatttgtgtgctgagtataataaaggctgagatcagaatctactcggaccttatccctttcaattgatcataactgtaatcaataaaaaatcacttacttgaaatctgatagcaagactctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttacagatgaaacgcgcgagatcgtctgacgagaccttcaaccccgtgtacccctacgataccgagatcgctccgacttctgtccctttccttacccctccctttgtatcatccgcaggaatgcaagaaaatccagctggggtgctgtccctgcacctgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaaccctttttgccactccccccctagcggtcagtggcgacaaccttactgtgcagtctcaggcccctcttactttggaagactcaaaactaactctggccaccaaaggacccctaactgtgtccgaaggcaaacttgtcctagaaacagagcctcccctgcatgcaagtgacagcagtagcctgggccttagcgtcacggccccacttagcattaacaatgacagcctaggactagacatgcaagcgcccatcagctctcgagatggaaaactggctctaacagtggcggcccccctaactgtggccgagggtatcaatgctttggcagtagccacaggtaatggtattggactaaatgaaaccaacacacacctgcaggcaaaactggtcgcgcccctaggctttgataccaacggcaacattaagctaagcgtcgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatgtaacatcttctaacaaccaaaacggtctagaggccaacattaaactaacaaaaggccttgtgtatgacggaaatgccatagcagttaatgttggcaaagggctggaatacagccctactggcacaacagaaaaacctatacagactaaaataggtctaggcatggagtatgacactgagggagccatgatgacaaaactaggctctggactaagctttgacaattcaggagccattgtggtgggaaacaaaaatgatgacaggcttactttgtggaccacaccggacccatcgcccaactgtcagatttactctgaaaaagatgctaaactaaccttggtactgactaaatgtggcagtcaggttg

SEQ ID NO: 714 - protein, 16 aa, Homo sapiens
GSTGCLTCRHHQTSHE

SEQ ID NO: 715 - protein, 15 aa, Homo sapiens
VVGRRHETAPQPLLV

SEQ ID NO: 716 - protein, 15 aa, Homo sapiens
APQPLLVPDRAGGEG

SEQ ID NO: 717 - protein, 9 aa, Homo sapiens
DRAGGEGGA

SEQ ID NO: 718 - protein, 15 aa, Homo sapiens
PVPTATPGVRSVTSP

SEQ ID NO: 719 - protein, 15 aa, Homo sapiens
VRSVTSPQGLGLFLK

SEQ ID NO: 720 - protein, 9 aa, Homo sapiens
GLGLFLKFI

SEQ ID NO: 721 - protein, 15 aa, Homo sapiens
KENDVREVCDVYLQM

SEQ ID NO: 722 - protein, 15 aa, Homo sapiens
CDVYLQMQIFFHFKF

SEQ ID NO: 723 - protein, 12 aa, Homo sapiens
IFFHFKFRSYFH

SEQ ID NO: 724 - protein, 15 aa, Homo sapiens
FARKMLEKVHRQHLQ

SEQ ID NO: 725 - protein, 14 aa, Homo sapiens
VHRQHLQLSHNSQE

SEQ ID NO: 726 - protein, 15 aa, Homo sapiens
MFLRKEQQVGPHSFS

SEQ ID NO: 727 - protein, 9 aa, Homo sapiens
VGPHSFSML

SEQ ID NO: 728 - protein, 15 aa, Homo sapiens
GLNLNTDRPGGYSYS

SEQ ID NO: 729 - protein, 15 aa, Homo sapiens
PGGYSYSIWWKNNAK

SEQ ID NO: 730 - protein, 9 aa, Homo sapiens
WWKNNAKNR

SEQ ID NO: 731 - protein, 15 aa, Homo sapiens
KVLNEIDAVVTVPPS

SEQ ID NO: 732 - protein, 15 aa, Homo sapiens
VVTVPPSLSTSQIPQ

SEQ ID NO: 733 - protein, 13 aa, Homo sapiens
STSQIPQGCCIIL

SEQ ID NO: 734 - protein, 15 aa, Homo sapiens
ANLKGTLQVRSGQAV

SEQ ID NO: 735 - protein, 10 aa, Homo sapiens
VRSGQAVSPR

SEQ ID NO: 736 - protein, 15 aa, Homo sapiens
LQAAASGQGKQGVPC

SEQ ID NO: 737 - protein, 15 aa, Homo sapiens
GKQGVPCPWGCCAYA

SEQ ID NO: 738 - protein, 15 aa, Homo sapiens
WGCCAYAESPRALIS

SEQ ID NO: 739 - protein, 15 aa, Homo sapiens
SPRALISGDAPSQVE

SEQ ID NO: 740 - protein, 15 aa, Homo sapiens
DAPSQVEREVPGPCL

SEQ ID NO: 741 - protein, 15 aa, Homo sapiens
EVPGPCLNTHSLSHR

SEQ ID NO: 742 - protein, 15 aa, Homo sapiens
THSLSHRSPQLPGLP

SEQ ID NO: 743 - protein, 14 aa, Homo sapiens
PQLPGLPHPKQPSV

SEQ ID NO: 744 - protein, 15 aa, Homo sapiens
GEVELSEGGEGQRHL

SEQ ID NO: 745 - protein, 15 aa, Homo sapiens
GEGQRHLAFPWACSG

SEQ ID NO: 746 - protein, 15 aa, Homo sapiens
FPWACSGPGWRGVCC

SEQ ID NO: 747 - protein, 15 aa, Homo sapiens
KMRAIQAEGGHGQAC

SEQ ID NO: 748 - protein, 15 aa, Homo sapiens
GGHGQACCGGAWGWA

SEQ ID NO: 749 - protein, 15 aa, Homo sapiens
GGAWGWAPGDGGPQG

SEQ ID NO: 750 - protein, 15 aa, Homo sapiens
GDGGPQGMLTHTLPT

SEQ ID NO: 751 - protein, 15 aa, Homo sapiens
LTHTLPTLGFQSAWT

SEQ ID NO: 752 - protein, 15 aa, Homo sapiens
GFQSAWTWRREDADR

SEQ ID NO: 753 - protein, 15 aa, Homo sapiens
RREDADRAWRTPKAC

SEQ ID NO: 754 - protein, 14 aa, Homo sapiens
WRTPKACASRRWSI

SEQ ID NO: 755 - protein, 15 aa, Homo sapiens
LLEPFRRGEPGPRGL

SEQ ID NO: 756 - protein, 15 aa, Homo sapiens
EPGPRGLLSGSSRGG

SEQ ID NO: 757 - protein, 15 aa, Homo sapiens
SGSSRGGEGPGRSIE

SEQ ID NO: 758 - protein, 15 aa, Homo sapiens
GPGRSIEAAPATPLP

SEQ ID NO: 759 - protein, 15 aa, Homo sapiens
APATPLPCCRKNPCR

SEQ ID NO: 760 - protein, 15 aa, Homo sapiens
CRKNPCRPQPSRFLP

SEQ ID NO: 761 - protein, 15 aa, Homo sapiens
QPSRFLPPRVLLVII

SEQ ID NO: 762 - protein, 15 aa, Homo sapiens
RVLLVIILPKLDCPK

SEQ ID NO: 763 - protein, 10 aa, Homo sapiens
PKLDCPKLGF

SEQ ID NO: 764 - protein, 15 aa, Homo sapiens
PSGRRTKRLVTLRSG

SEQ ID NO: 765 - protein, 15 aa, Homo sapiens
LVTLRSGCAIQCWHP

SEQ ID NO: 766 - protein, 15 aa, Homo sapiens
AIQCWHPRAGPVPSA

SEQ ID NO: 767 - protein, 15 aa, Homo sapiens
AGPVPSALPHTERPP

SEQ ID NO: 768 - protein, 15 aa, Homo sapiens
PHTERPPRLVRGAAD

SEQ ID NO: 769 - protein, 15 aa, Homo sapiens
LVRGAADPRTVTLGR

SEQ ID NO: 770 - protein, 15 aa, Homo sapiens
RTVTLGRSPAVMPRA

SEQ ID NO: 771 - protein, 9 aa, Homo sapiens
PAVMPRAPA

SEQ ID NO: 772 - protein, 15 aa, Homo sapiens
DCMLSEEGGQARRGG

SEQ ID NO: 773 - protein, 15 aa, Homo sapiens
GQARRGGSLCSLAAH

SEQ ID NO: 774 - protein, 15 aa, Homo sapiens
LCSLAAHTIASAARG

SEQ ID NO: 775 - protein, 15 aa, Homo sapiens
IASAARGRFLSRLSN

SEQ ID NO: 776 - protein, 15 aa, Homo sapiens
FLSRLSNFCAVVKAS

SEQ ID NO: 777 - protein, 16 aa, Homo sapiens
CAVVKASRGAPSCTWE

SEQ ID NO: 778 - protein, 15 aa, Homo sapiens
PEPRRLSPGEPRGRP

SEQ ID NO: 779 - protein, 15 aa, Homo sapiens
GEPRGRPRKGWGIWG

SEQ ID NO: 780 - protein, 15 aa, Homo sapiens
KGWGIWGLCGARVGP

SEQ ID NO: 781 - protein, 11 aa, Homo sapiens
CGARVGPKAWR

SEQ ID NO: 782 - protein, 15 aa, Homo sapiens
FVSLTAIQMASSATP

SEQ ID NO: 783 - protein, 15 aa, Homo sapiens
MASSATPWGRWPVAT

SEQ ID NO: 784 - protein, 15 aa, Homo sapiens
GRWPVATPTAACPRR

SEQ ID NO: 785 - protein, 15 aa, Homo sapiens
TAACPRRRPSSLPTG

SEQ ID NO: 786 - protein, 15 aa, Homo sapiens
PSSLPTGGDSASKKP

SEQ ID NO: 787 - protein, 15 aa, Homo sapiens
DSASKKPISRRAPWQ

SEQ ID NO: 788 - protein, 15 aa, Homo sapiens
SRRAPWQPWACPGRS

SEQ ID NO: 789 - protein, 15 aa, Homo sapiens
WACPGRSVNSAAPRA

SEQ ID NO: 790 - protein, 15 aa, Homo sapiens
NSAAPRAWCPPATTP

SEQ ID NO: 791 - protein, 15 aa, Homo sapiens
CPPATTPRTQSPSRD

SEQ ID NO: 792 - protein, 15 aa, Homo sapiens
TQSPSRDLRPRCLSS

SEQ ID NO: 793 - protein, 10 aa, Homo sapiens
RPRCLSSWSS

SEQ ID NO: 794 - protein, 15 aa, Homo sapiens
PVAIKPGTGPPNNSS

SEQ ID NO: 795 - protein, 15 aa, Homo sapiens
GPPNNSSIHGGSKRS

SEQ ID NO: 796 - protein, 15 aa, Homo sapiens
HGGSKRSENSYCRDL

SEQ ID NO: 797 - protein, 15 aa, Homo sapiens
NSYCRDLRGQLRAIC

SEQ ID NO: 798 - protein, 15 aa, Homo sapiens
GQLRAICCSSYSHDR

SEQ ID NO: 799 - protein, 15 aa, Homo sapiens
SSYSHDRHTTEERGS

SEQ ID NO: 800 - protein, 15 aa, Homo sapiens
TTEERGSRGRHVWRI

SEQ ID NO: 801 - protein, 15 aa, Homo sapiens
GRHVWRIRRLHTSGL

SEQ ID NO: 802 - protein, 15 aa, Homo sapiens
RLHTSGLPCCCHSGP

SEQ ID NO: 803 - protein, 15 aa, Homo sapiens
CCCHSGPHPRRLPDI

SEQ ID NO: 804 - protein, 15 aa, Homo sapiens
PRRLPDILRLVTSTK

SEQ ID NO: 805 - protein, 15 aa, Homo sapiens
RLVTSTKTDHTNTTE

SEQ ID NO: 806 - protein, 13 aa, Homo sapiens
DHTNTTEGTLDYL

SEQ ID NO: 807 - protein, 15 aa, Homo sapiens
KWNKNWTATLGALTI

SEQ ID NO: 808 - protein, 15 aa, Homo sapiens
TLGALTIRGHKLLCH

SEQ ID NO: 809 - protein, 15 aa, Homo sapiens
GHKLLCHLPHLLSSV

SEQ ID NO: 810 - protein, 16 aa, Homo sapiens
PHLLSSVQQTCRSSSR

SEQ ID NO: 811 - protein, 15 aa, Homo sapiens
ENASLVFTGSNSPIP

SEQ ID NO: 812 - protein, 15 aa, Homo sapiens
GSNSPIPACELSSHP

SEQ ID NO: 813 - protein, 15 aa, Homo sapiens
CELSSHPAHGISPWI

SEQ ID NO: 814 - protein, 15 aa, Homo sapiens
HGISPWIPSPGNEHF

SEQ ID NO: 815 - protein, 15 aa, Homo sapiens
SPGNEHFHGIKKQVK

SEQ ID NO: 816 - protein, 12 aa, Homo sapiens
GIKKQVKAIKVE

SEQ ID NO: 817 - protein, 15 aa, Homo sapiens
RLTQRLVQGWTPMEN

SEQ ID NO: 818 - protein, 15 aa, Homo sapiens
GWTPMENRWCGRRAG

SEQ ID NO: 819 - protein, 15 aa, Homo sapiens
WCGRRAGGQPASSST

SEQ ID NO: 820 - protein, 15 aa, Homo sapiens
QPASSSTRWTTCRAA

SEQ ID NO: 821 - protein, 15 aa, Homo sapiens
WTTCRAACLLTKWTA

SEQ ID NO: 822 - protein, 15 aa, Homo sapiens
LLTKWTAGRSQTSIG

SEQ ID NO: 823 - protein, 15 aa, Homo sapiens
ENSGNASRWLHVPSS

SEQ ID NO: 824 - protein, 15 aa, Homo sapiens
WLHVPSSSDDWLGWK

SEQ ID NO: 825 - protein, 16 aa, Homo sapiens
DDWLGWKKSSAITSNS

SEQ ID NO: 826 - protein, 15 aa, Homo sapiens
KGSVERRSVSLGHPA

SEQ ID NO: 827 - protein, 15 aa, Homo sapiens
VSLGHPAEGWAWAER

SEQ ID NO: 828 - protein, 15 aa, Homo sapiens
GWAWAERSLQPGMTT

SEQ ID NO: 829 - protein, 15 aa, Homo sapiens
LQPGMTTANTGCLSF

SEQ ID NO: 830 - protein, 15 aa, Homo sapiens
NTGCLSFHHRGCLLP

SEQ ID NO: 831 - protein, 15 aa, Homo sapiens
HRGCLLPVLPKLHCG

SEQ ID NO: 832 - protein, 15 aa, Homo sapiens
LPKLHCGLGGLPLVR

SEQ ID NO: 833 - protein, 15 aa, Homo sapiens
GGLPLVRAKEIKRVQ

SEQ ID NO: 834 - protein, 15 aa, Homo sapiens
KEIKRVQRAGESSLP

SEQ ID NO: 835 - protein, 15 aa, Homo sapiens
AGESSLPVKGLLTVA

SEQ ID NO: 836 - protein, 15 aa, Homo sapiens
KGLLTVASAVIAVLW

SEQ ID NO: 837 - protein, 15 aa, Homo sapiens
AVIAVLWGRPSEVTG

SEQ ID NO: 838 - protein, 14 aa, Homo sapiens
RPSEVTGENEAQHD

SEQ ID NO: 839 - protein, 15 aa, Homo sapiens
FGLTTLAGRSSHGTS

SEQ ID NO: 840 - protein, 15 aa, Homo sapiens
RSSHGTSGLRAATHT

SEQ ID NO: 841 - protein, 15 aa, Homo sapiens
LRAATHTKSGDGGQG

SEQ ID NO: 842 - protein, 15 aa, Homo sapiens
SGDGGQGAARQCEKL

SEQ ID NO: 843 - protein, 15 aa, Homo sapiens
ARQCEKLLELARATR

SEQ ID NO: 844 - protein, 15 aa, Homo sapiens
ELARATRPWGRSTSA

SEQ ID NO: 845 - protein, 15 aa, Homo sapiens
WGRSTSASSRWTHRG

SEQ ID NO: 846 - protein, 15 aa, Homo sapiens
SRWTHRGYMCPPRCA

SEQ ID NO: 847 - protein, 11 aa, Homo sapiens
MCPPRCAVACW

SEQ ID NO: 848 - protein, 15 aa, Homo sapiens
IIDSDKIMAVCMGCL

SEQ ID NO: 849 - protein, 15 aa, Homo sapiens
DKIMAVCMGCLLTRH

SEQ ID NO: 850 - protein, 15 aa, Homo sapiens
AVCMGCLLTRHVQCQ

SEQ ID NO: 851 - protein, 15 aa, Homo sapiens
GCLLTRHVQCQAMEM

SEQ ID NO: 852 - protein, 13 aa, Homo sapiens
TRHVQCQAMEMQQ

SEQ ID NO: 853 - protein, 16 aa, Homo sapiens
LSIFLFLMLCKLEFHA

SEQ ID NO: 854 - protein, 15 aa, Homo sapiens
LLNAEDYRCAIHSKE

SEQ ID NO: 855 - protein, 15 aa, Homo sapiens
CAIHSKEIYLLSPSP

SEQ ID NO: 856 - protein, 15 aa, Homo sapiens
YLLSPSPHQAMDKFS

SEQ ID NO: 857 - protein, 15 aa, Homo sapiens
QAMDKFSLCCINCNL

SEQ ID NO: 858 - protein, 15 aa, Homo sapiens
CCINCNLCLHVFLLL

SEQ ID NO: 859 - protein, 15 aa, Homo sapiens
LHVFLLLLFFQNKDV

SEQ ID NO: 860 - protein, 15 aa, Homo sapiens
FFQNKDVWLISNIIL

SEQ ID NO: 861 - protein, 14 aa, Homo sapiens
LISNIILLWIYGGI

SEQ ID NO: 862 - protein, 15 aa, Homo sapiens
VETLENANSFSSGIQ

SEQ ID NO: 863 - protein, 15 aa, Homo sapiens
SFSSGIQPLLCSLIG

SEQ ID NO: 864 - protein, 12 aa, Homo sapiens
LLCSLIGLENPT

SEQ ID NO: 865 - protein, 15 aa, Homo sapiens
AGAGTISEGSVLHGQ

SEQ ID NO: 866 - protein, 15 aa, Homo sapiens
GSVLHGQRLECDARR

SEQ ID NO: 867 - protein, 15 aa, Homo sapiens
LECDARRFFGCGTTI

SEQ ID NO: 868 - protein, 14 aa, Homo sapiens
FGCGTTILAEWEHH

SEQ ID NO: 869 - protein, 15 aa, Homo sapiens
KEQILAVASLVSSQS

SEQ ID NO: 870 - protein, 15 aa, Homo sapiens
SLVSSQSIHPSWGQS

SEQ ID NO: 871 - protein, 12 aa, Homo sapiens
HPSWGQSPLSRI

SEQ ID NO: 872 - protein, 15 aa, Homo sapiens
QQLRIFCAAMASNED

SEQ ID NO: 873 - protein, 9 aa, Homo sapiens
AMASNEDFS

SEQ ID NO: 874 - protein, 15 aa, Homo sapiens
DGFSGSLFAVVTRRC

SEQ ID NO: 875 - protein, 15 aa, Homo sapiens
AVVTRRCYFLKWRTI

SEQ ID NO: 876 - protein, 15 aa, Homo sapiens
FLKWRTIFPQSLMWL

SEQ ID NO: 877 - protein, 15 aa, Homo sapiens
DLRRVATYCAPLPSS

SEQ ID NO: 878 - protein, 15 aa, Homo sapiens
CAPLPSSWRPGTGTT

SEQ ID NO: 879 - protein, 15 aa, Homo sapiens
RPGTGTTIPPRMRSC

SEQ ID NO: 880 - protein, 15 aa, Homo sapiens
LQERMELLACGAERG

SEQ ID NO: 881 - protein, 15 aa, Homo sapiens
ACGAERGAGGWGGGG

SEQ ID NO: 882 - protein, 15 aa, Homo sapiens
GGWGGGGGGGGGDRR

SEQ ID NO: 883 - protein, 15 aa, Homo sapiens
GGGGDRRGGGGSAPA

SEQ ID NO: 884 - protein, 16 aa, Homo sapiens
GGGSAPALADFAGGRG

SEQ ID NO: 885 - protein, 15 aa, Homo sapiens
WTDIVKQSVSTNCIS

SEQ ID NO: 886 - protein, 15 aa, Homo sapiens
VSTNCISIKKGSYTK

SEQ ID NO: 887 - protein, 15 aa, Homo sapiens
KKGSYTKLFSLVFLI

SEQ ID NO: 888 - protein, 16 aa, Homo sapiens
FSLVFLIFCWPLIIQL

SEQ ID NO: 889 - protein, 15 aa, Homo sapiens
LRYGALCNVSRISYF

SEQ ID NO: 890 - protein, 15 aa, Homo sapiens
VSRISYFSLTNIFNF

SEQ ID NO: 891 - protein, 15 aa, Homo sapiens
LTNIFNFVIKSLTAI

SEQ ID NO: 892 - protein, 15 aa, Homo sapiens
RKERNIRKSESTLRL

SEQ ID NO: 893 - protein, 15 aa, Homo sapiens
SESTLRLSPFPTPAP

SEQ ID NO: 894 - protein, 15 aa, Homo sapiens
PFPTPAPSGAPAAAQ

SEQ ID NO: 895 - protein, 15 aa, Homo sapiens
GAPAAAQGKVVRVPG

SEQ ID NO: 896 - protein, 15 aa, Homo sapiens
KVVRVPGPAGGLVPR

SEQ ID NO: 897 - protein, 15 aa, Homo sapiens
AGGLVPRDAGARLLP

SEQ ID NO: 898 - protein, 15 aa, Homo sapiens
AGARLLPPAGGPGGG

SEQ ID NO: 899 - protein, 15 aa, Homo sapiens
AGGPGGGAAAGEGRA

SEQ ID NO: 900 - protein, 15 aa, Homo sapiens
AAGEGRAGRGRFPSI

SEQ ID NO: 901 - protein, 15 aa, Homo sapiens
RGRFPSITEPRPRDL

SEQ ID NO: 902 - protein, 15 aa, Homo sapiens
EPRPRDLPPRVATGR

SEQ ID NO: 903 - protein, 15 aa, Homo sapiens
PRVATGRRAGGRRKG

SEQ ID NO: 904 - protein, 15 aa, Homo sapiens
AGGRRKGAGQGVRTR

SEQ ID NO: 905 - protein, 15 aa, Homo sapiens
GQGVRTRPLPASWPG

SEQ ID NO: 906 - protein, 15 aa, Homo sapiens
LPASWPGGRGPFRKG

SEQ ID NO: 907 - protein, 15 aa, Homo sapiens
RGPFRKGPRRLPLGS

SEQ ID NO: 908 - protein, 15 aa, Homo sapiens
RRLPLGSGPPAAGVQ

SEQ ID NO: 909 - protein, 15 aa, Homo sapiens
PPAAGVQRLRCSHLS

SEQ ID NO: 910 - protein, 15 aa, Homo sapiens
LRCSHLSRGPRRRRG

SEQ ID NO: 911 - protein, 15 aa, Homo sapiens
GPRRRRGRVCGRACV

SEQ ID NO: 912 - protein, 15 aa, Homo sapiens
VCGRACVSPPLPPRP

SEQ ID NO: 913 - protein, 15 aa, Homo sapiens
PPLPPRPPPVGLSAE

SEQ ID NO: 914 - protein, 15 aa, Homo sapiens
PVGLSAENLSWLSSG

SEQ ID NO: 915 - protein, 15 aa, Homo sapiens
LSWLSSGLPRACSWR

SEQ ID NO: 916 - protein, 15 aa, Homo sapiens
PRACSWREFSPETCA

SEQ ID NO: 917 - protein, 15 aa, Homo sapiens
FSPETCAFRLSGLDS

SEQ ID NO: 918 - protein, 15 aa, Homo sapiens
RLSGLDSKLSARVER

SEQ ID NO: 919 - protein, 15 aa, Homo sapiens
LSARVERDLGALRAP

SEQ ID NO: 920 - protein, 15 aa, Homo sapiens
LGALRAPGSRAAQGG

SEQ ID NO: 921 - protein, 15 aa, Homo sapiens
SRAAQGGGRVRGSRS

SEQ ID NO: 922 - protein, 15 aa, Homo sapiens
RVRGSRSEWKTRPWR

SEQ ID NO: 923 - protein, 15 aa, Homo sapiens
WKTRPWRPPPAWPLT

SEQ ID NO: 924 - protein, 15 aa, Homo sapiens
PPAWPLTRAGGPLPK

SEQ ID NO: 925 - protein, 15 aa, Homo sapiens
AGGPLPKNPFLESCS

SEQ ID NO: 926 - protein, 15 aa, Homo sapiens
PFLESCSETAQRRRV

SEQ ID NO: 927 - protein, 15 aa, Homo sapiens
TAQRRRVFSFSTPLS

SEQ ID NO: 928 - protein, 15 aa, Homo sapiens
SINKATITGKKDLEL

SEQ ID NO: 929 - protein, 15 aa, Homo sapiens
GKKDLELILHVSRKK

SEQ ID NO: 930 - protein, 15 aa, Homo sapiens
LHVSRKKPFLPRVNI

SEQ ID NO: 931 - protein, 15 aa, Homo sapiens
FLPRVNITPTPISCC

SEQ ID NO: 932 - protein, 15 aa, Homo sapiens
PTPISCCNLKMLKKF

SEQ ID NO: 933 - protein, 15 aa, Homo sapiens
LKMLKKFFLLYIIIS

SEQ ID NO: 934 - protein, 15 aa, Homo sapiens
LLYIIISIIDLTNCL

SEQ ID NO: 935 - protein, 15 aa, Homo sapiens
IDLTNCLSCYLEHFY

SEQ ID NO: 936 - protein, 15 aa, Homo sapiens
CYLEHFYRFTFFTDV

SEQ ID NO: 937 - protein, 10 aa, Homo sapiens
FTFFTDVHYF

SEQ ID NO: 938 - protein, 15 aa, Homo sapiens
PYYSALSGNSWVPST

SEQ ID NO: 939 - protein, 15 aa, Homo sapiens
NSWVPSTLESDPFGY

SEQ ID NO: 940 - protein, 15 aa, Homo sapiens
ESDPFGYVFSPLATR

SEQ ID NO: 941 - protein, 15 aa, Homo sapiens
FSPLATRPALNDQES

SEQ ID NO: 942 - protein, 15 aa, Homo sapiens
ALNDQESILWPTLTS

SEQ ID NO: 943 - protein, 15 aa, Homo sapiens
LWPTLTSVVSCALSC

SEQ ID NO: 944 - protein, 15 aa, Homo sapiens
VSCALSCPSLNLPEN

SEQ ID NO: 945 - protein, 15 aa, Homo sapiens
SLNLPENWLTLITGG

SEQ ID NO: 946 - protein, 15 aa, Homo sapiens
LTLITGGMKGGKKMK

SEQ ID NO: 947 - protein, 12 aa, Homo sapiens
KGGKKMKFTFRH

SEQ ID NO: 948 - protein, 15 aa, Homo sapiens
GLRNLGNTVRAILLS

SEQ ID NO: 949 - protein, 15 aa, Homo sapiens
VRAILLSFLSKRNVK

SEQ ID NO: 950 - protein, 15 aa, Homo sapiens
LSKRNVKWCWGWGKP

SEQ ID NO: 951 - protein, 15 aa, Homo sapiens
CWGWGKPTSLGKACG

SEQ ID NO: 952 - protein, 14 aa, Homo sapiens
SLGKACGRRALKLF

SEQ ID NO: 953 - protein, 15 aa, Homo sapiens
MEAENAGSLHFHEVL

SEQ ID NO: 954 - protein, 14 aa, Homo sapiens
LHFHEVLKMGHVKF

SEQ ID NO: 955 - protein, 15 aa, Homo sapiens
WTPIPVLTRWPLPHP

SEQ ID NO: 956 - protein, 15 aa, Homo sapiens
RWPLPHPPPWRRATS

SEQ ID NO: 957 - protein, 15 aa, Homo sapiens
PWRRATSCRMARSSP

SEQ ID NO: 958 - protein, 15 aa, Homo sapiens
RMARSSPSATSGSSV

SEQ ID NO: 959 - protein, 15 aa, Homo sapiens
ATSGSSVRRRCSSLP

SEQ ID NO: 960 - protein, 15 aa, Homo sapiens
RRCSSLPSWVWNLAA

SEQ ID NO: 961 - protein, 16 aa, Homo sapiens
WVWNLAASTRPRSTPS

SEQ ID NO: 962 - protein, 15 aa, Homo sapiens
LHPQRETFTPRWSGA

SEQ ID NO: 963 - protein, 15 aa, Homo sapiens
TPRWSGANYWKLAFP

SEQ ID NO: 964 - protein, 15 aa, Homo sapiens
YWKLAFPVGAEGTFP

SEQ ID NO: 965 - protein, 15 aa, Homo sapiens
GAEGTFPAAATQRGV

SEQ ID NO: 966 - protein, 11 aa, Homo sapiens
AATQRGVVRPA

SEQ ID NO: 967 - protein, 15 aa, Homo sapiens
MAGGVLRRLLCREPD

SEQ ID NO: 968 - protein, 15 aa, Homo sapiens
LLCREPDRDGDKGAS

SEQ ID NO: 969 - protein, 15 aa, Homo sapiens
DGDKGASREETVVPL

SEQ ID NO: 970 - protein, 15 aa, Homo sapiens
EETVVPLHIGDPVVL

SEQ ID NO: 971 - protein, 15 aa, Homo sapiens
IGDPVVLPGIGQCYS

SEQ ID NO: 972 - protein, 10 aa, Homo sapiens
GIGQCYSALF

SEQ ID NO: 973 - protein, 15 aa, Homo sapiens
VFFKRAAEGFFRMNK

SEQ ID NO: 974 - protein, 15 aa, Homo sapiens
GFFRMNKLKESSDTN

SEQ ID NO: 975 - protein, 15 aa, Homo sapiens
KESSDTNPKPYCMAA

SEQ ID NO: 976 - protein, 15 aa, Homo sapiens
KPYCMAAPMGLTENN

SEQ ID NO: 977 - protein, 15 aa, Homo sapiens
MGLTENNRNRKKSYR

SEQ ID NO: 978 - protein, 15 aa, Homo sapiens
NRKKSYRETNLKAVS

SEQ ID NO: 979 - protein, 13 aa, Homo sapiens
TNLKAVSWPLNHT

SEQ ID NO: 980 - protein, 13 aa, Homo sapiens
GWRGVCCAAVEPA

SEQ ID NO: 981 - DNA, 10712 bp, Artificial Sequence
  self-replicating RNA plasmid
taatacgactcactatagataggcggcgcatgagagaagcccagaccaattacctacccaaataggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaatagtcagcatagtacatttcatctgactaatactacaacaccaccaccatgaatagaggattctttaacatgctcggccgccgccccttcccggcccccactgccatgtggaggccgcggagaaggaggcaggcggccccgggaagcggagctactaacttcagcctgctgaagcaggctggagacgtggaggagaaccctggacctgagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctctgaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgcatacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggctaacctgaatggactacgacatagtctagtccgccaagatatcggcgcgccgtttaaacggccggccttaattaagtaacgatacagcagcaattggcaagctgcttacatagaactcgcggcgattggcatgccgctttaaaatttttattttatttttcttttcttttccgaatcggattttgtttttaatatttcaaaaaaaaaaaaaaaaaaaaaaaaaaaaaaaaaaaaaaacccctctctaaacggaggggtttttttcagcgtaactggactggccacagttaggcggccgcgcatgttcatcatcagtaacccgtatcgtgagcatcctctctcgtttcatcggtatcattacctccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttattagaaaaattcatccagcagacgataaaacgcaatacgctggctatccggtgccgcaatgccatacagcaccagaaaacgatccgcccattcgccgcccagttcttccgcaatatcacgggtggccagcgcaatatcctgataacgatccgccacgcccagacggccgcaatcaataaagccgctaaaacggccattttccaccataatgttcggcaggcacgcatcaccatgggtcaccaccagatcttcgccatccggcatgctcgctttcagacgcgcaaacagctctgccggtgccaggccctgatgttcttcatccagatcatcctgatccaccaggcccgcttccatacgggtacgcgcacgttcaatacgatgtttcgcctgatgatcaaacggacaggtcgccgggtccagggtatgcagacgacgcatggcatccgccataatgctcactttttctgccggcgccagatggctagacagcagatcctgacccggcacttcgcccagcagcagccaatcacggcccgcttcggtcaccacatccagcaccgccgcacacggaacaccggtggtggccagccagctcagacgcgccgcttcatcctgcagctcgttcagcgcaccgctcagatcggttttcacaaacagcaccggacgaccctgcgcgctcagacgaaacaccgccgcatcagagcagccaatggtctgctgcgcccaatcatagccaaacagacgttccacccacgctgccgggctacccgcatgcaggccatcctgttcaatcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaagcatccgcctttcgttttatttgaccatgttggtatg

SEQ ID NO: 982 - DNA, 29 bp, Artificial Sequence
  T7 terminator
aacccctctctaaacggaggggttttttt

SEQ ID NO: 983 - DNA, 105 bp, Artificial Sequence
  AmpR promoter
cgcggaacccctatttgtttatttttctaaatacattcaaatatgtatccgctcatgagacaataaccctgataaatgcttcaataatattgaaaaaggaagagt

SEQ ID NO: 984 - DNA, 24 bp, Artificial Sequence
  26S promoter
ctctctacggctaacctgaatgga

SEQ ID NO: 985 - DNA, 18 bp, Artificial Sequence
  T7 promoter
taatacgactcactatag

SEQ ID NO: 986 - DNA, 39 bp, Artificial Sequence
  Poly A site
aaaaaaaaaaaaaaaaaaaaaaaaaaaaaaaaaaaaaaa

SEQ ID NO: 987 - DNA, 195 bp, Artificial Sequence
  Alpha 5' replication nsP1 sequence
taggagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattgga

SEQ ID NO: 988 - DNA, 142 bp, Artificial Sequence
  DLP
atagtcagcatagtacatttcatctgactaatactacaacaccaccaccatgaatagaggattctttaacatgctcggccgccgccccttcccggcccccactgccatgtggaggccgcggagaaggaggcaggcggccccg

SEQ ID NO: 989 - DNA, 66 bp, Artificial Sequence
  P2A
ggaagcggagctactaacttcagcctgctgaagcaggctggagacgtggaggagaaccctggacct

SEQ ID NO: 990 - DNA, 141 bp, Artificial Sequence
  Bon
cgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcagg

SEQ ID NO: 991 - DNA, 5796 bp, Artificial Sequence
  DLP nsp ORF
atgaatagaggattctttaacatgctcggccgccgccccttcccggcccccactgccatgtggaggccgcggagaaggaggcaggcggccccgggaagcggagctactaacttcagcctgctgaagcaggctggagacgtggaggagaaccctggacctgagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggccggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctctgaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgtgcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatga

SEQ ID NO: 992 - DNA, 2382 bp, Artificial Sequence
  nsP2
ggctcagtggagacacctcgtggcttgataaaggttaccagctacgatggcgaggacaagatcggctcttacgctgtgctttctccgcaggctgtactcaagagtgaaaaattatcttgcatccaccctctcgctgaacaagtcatagtgataacacactctggccgaaaagggcgttatgccgtggaaccataccatggtaaagtagtggtgccagagggacatgcaatacccgtccaggactttcaagctctgagtgaaagtgccaccattgtgtacaacgaacgtgagttcgtaaacaggtacctgcaccatattgccacacatggaggagcgctgaacactgatgaagaatattacaaaactgtcaagcccagcgagcacgacggcgaatacctgtacgacatcgacaggaaacagtgcgtcaagaaagaactagtcactgggctagggctcacaggcgagctggtggatcctcccttccatgaattcgcctacgagagtctgagaacacgaccagccgctccttaccaagtaccaaccataggggtgtatggcgtgccaggatcaggcaagtctggcatcattaaaagcgcagtcaccaaaaaagatctagtggtgagcgccaagaaagaaaactgtgcagaaattataagggacgtcaagaaaatgaaagggctggacgtcaatgccagaactgtggactcagtgctcttgaatggatgcaaacaccccgtagagaccctgtatattgacgaagcttttgcttgtcatgcaggtactctcagagcgctcatagccattataagacctaaaaaggcagtgctctgcggggatcccaaacagtgcggtttttttaacatgatgtgcctgaaagtgcattttaaccacgagatttgcacacaagtcttccacaaaagcatctctcgccgttgcactaaatctgtgacttcggtcgtctcaaccttgttttacgacaaaaaaatgagaacgacgaatccgaaagagactaagattgtgattgacactaccggcagtaccaaacctaagcaggacgatctcattctcacttgtttcagagggtgggtgaagcagttgcaaatagattacaaaggcaacgaaataatgacggcagctgcctctcaagggctgacccgtaaaggtgtgtatgccgttcggtacaaggtgaatgaaaatcctctgtacgcacccacctctgaacatgtgaacgtcctactgacccgcacggaggaccgcatcgtgtggaaaacactagccggcgacccatggataaaaacactgactgccaagtaccctgggaatttcactgccacgatagaggagtggcaagcagagcatgatgccatcatgaggcacatcttggagagaccggaccctaccgacgtcttccagaataaggcaaacgtgtgttgggccaaggctttagtgccggtgctgaagaccgctggcatagacatgaccactgaacaatggaacactgtggattattttgaaacggacaaagctcactcagcagagatagtattgaaccaactatgcgtgaggttctttggactcgatctggactccggtctattttctgcacccactgttccgttatccattaggaataatcactgggataactccccgtcgcctaacatgtacgggctgaataaagaagtggtccgtcagctctctcgcaggtacccacaactgcctcgggcagttgccactggaagagtctatgacatgaacactggtacactgcgcaattatgatccgcgcataaacctagtacctgtaaacagaagactgcctcatgctttagtcctccaccataatgaacacccacagagtgacttttcttcattcgtcagcaaattgaagggcagaactgtcctggtggtcggggaaaagttgtccgtcccaggcaaaatggttgactggttgtcagaccggcctgaggctaccttcagagctcggctggatttaggcatcccaggtgatgtgcccaaatatgacataatatttgttaatgtgaggaccccatataaataccatcactatcagcagtgtgaagaccatgccattaagcttagcatgttgaccaagaaagcttgtctgcatctgaatcccggcggaacctgtgtcagcataggttatggttacgctgacagggccagcgaaagcatcattggtgctatagcgcggcagttcaagttttcccgggtatgcaaaccgaaatcctcacttgaagagacggaagttctgtttgtattcattgggtacgatcgcaaggcccgtacgcacaatccttacaagctttcatcaaccttgaccaacatttatacaggttccagactccacgaagccggatgt

SEQ ID NO: 993 - DNA, 1821 bp, Artificial Sequence
  nsP4
tacatcttttcctccgacaccggtcaagggcatttacaacaaaaatcagtaaggcaaacggtgctatccgaagtggtgttggagaggaccgaattggagatttcgtatgccccgcgcctcgaccaagaaaaagaagaattactacgcaagaaattacagttaaatcccacacctgctaacagaagcagataccagtccaggaaggtggagaacatgaaagccataacagctagacgtattctgcaaggcctagggcattatttgaaggcagaaggaaaagtggagtgctaccgaaccctgcatcctgttcctttgtattcatctagtgtgaaccgtgccttttcaagccccaaggtcgcagtggaagcctgtaacgccatgttgaaagagaactttccgactgtggcttcttactgtattattccagagtacgatgcctatttggacatggttgacggagcttcatgctgcttagacactgccagtttttgccctgcaaagctgcgcagctttccaaagaaacactcctatttggaacccacaatacgatcggcagtgccttcagcgatccagaacacgctccagaacgtcctggcagctgccacaaaaagaaattgcaatgtcacgcaaatgagagaattgcccgtattggattcggcggcctttaatgtggaatgcttcaagaaatatgcgtgtaataatgaatattgggaaacgtttaaagaaaaccccatcaggcttactgaagaaaacgtggtaaattacattaccaaattaaaaggaccaaaagctgctgctctttttgcgaagacacataatttgaatatgttgcaggacataccaatggacaggtttgtaatggacttaaagagagacgtgaaagtgactccaggaacaaaacatactgaagaacggcccaaggtacaggtgatccaggctgccgatccgctagcaacagcgtatctgtgcggaatccaccgagagctggttaggagattaaatgcggtcctgcttccgaacattcatacactgtttgatatgtcggctgaagactttgacgctattatagccgagcacttccagcctggggattgtgttctggaaactgacatcgcgtcgtttgataaaagtgaggacgacgccatggctctgaccgcgttaatgattctggaagacttaggtgtggacgcagagctgttgacgctgattgaggcggctttcggcgaaatttcatcaatacatttgcccactaaaactaaatttaaattcggagccatgatgaaatctggaatgttcctcacactgtttgtgaacacagtcattaacattgtaatcgcaagcagagtgttgagagaacggctaaccggatcaccatgtgcagcattcattggagatgacaatatcgtgaaaggagtcaaatcggacaaattaatggcagacaggtgcgccacctggttgaatatggaagtcaagattatagatgctgtggtgggcgagaaagcgccttatttctgtggagggtttattttgtgtgactccgtgaccggcacagcgtgccgtgtggcagaccccctaaaaaggctgtttaagcttggcaaacctctggcagcagacgatgaacatgatgatgacaggagaagggcattgcatgaagagtcaacacgctggaaccgagtgggtattctttcagagctgtgcaaggcagtagaatcaaggtatgaaaccgtaggaacttccatcatagttatggccatgactactctagctagcagtgttaaatcattcagctacctgagaggggcccctataactctctacggc

SEQ ID NO: 994 - DNA, 1671 bp, Artificial Sequence
  nsP3
gcaccctcatatcatgtggtgcgaggggatattgccacggccaccgaaggagtgattataaatgctgctaacagcaaaggacaacctggcggaggggtgtgcggagcgctgtataagaaattcccggaaagcttcgatttacagccgatcgaagtaggaaaagcgcgactggtcaaaggtgcagctaaacatatcattcatgccgtaggaccaaacttcaacaaagtttcggaggttgaaggtgacaaacagttggcagaggcttatgagtccatcgctaagattgtcaacgataacaattacaagtcagtagcgattccactgttgtccaccggcatcttttccgggaacaaagatcgactaacccaatcattgaaccatttgctgacagctttagacaccactgatgcagatgtagccatatactgcagggacaagaaatgggaaatgactctcaaggaagcagtggctaggagagaagcagtggaggagatatgcatatccgacgactcttcagtgacagaacctgatgcagagctggtgagggtgcatccgaagagttctttggctggaaggaagggctacagcacaagcgatggcaaaactttctcatatttggaagggaccaagtttcaccaggcggccaaggatatagcagaaattaatgccatgtggcccgttgcaacggaggccaatgagcaggtatgcatgtatatcctcggagaaagcatgagcagtattaggtcgaaatgccccgtcgaagagtcggaagcctccacaccacctagcacgctgccttgcttgtgcatccatgccatgactccagaaagagtacagcgcctaaaagcctcacgtccagaacaaattactgtgtgctcatcctttccattgccgaagtatagaatcactggtgtgcagaagatccaatgctcccagcctatattgttctcaccgaaagtgcctgcgtatattcatccaaggaagtatctcgtggaaacaccaccggtagacgagactccggagccatcggcagagaaccaatccacagaggggacacctgaacaaccaccacttataaccgaggatgagaccaggactagaacgcctgagccgatcatcatcgaagaggaagaagaggatagcataagtttgctgtcagatggcccgacccaccaggtgctgcaagtcgaggcagacattcacgggccgccctctgtatctagctcatcctggtccattcctcatgcatccgactttgatgtggacagtttatccatacttgacaccctggagggagctagcgtgaccagcggggcaacgtcagccgagactaactcttacttcgcaaagagtatggagtttctggcgcgaccggtgcctgcgcctcgaacagtattcaggaaccctccacatcccgctccgcgcacaagaacaccgtcacttgcacccagcagggcctgctcgagaaccagcctagtttccaccccgccaggcgtgaatagggtgatcactagagaggagctcgaggcgcttaccccgtcacgcactcctagcaggtcggtctcgagaaccagcctggtctccaacccgccaggcgtaaatagggtgattacaagagaggagtttgaggcgttcgtagcacaacaacaatgacggtttgatgcgggtgca

SEQ ID NO: 995 - DNA, 1602 bp, Artificial Sequence
  nsP1
gagaaagttcacgttgacatcgaggaagacagcccattcctcagagctttgcagcggagcttcccgcagtttgaggtagaagccaagcaggtcactgataatgaccatgctaatgccagagcgttttcgcatctggcttcaaaactgatcgaaacggaggtggacccatccgacacgatccttgacattggaagtgcgcccgcccgcagaatgtattctaagcacaagtatcattgtatctgtccgatgagatgtgcggaagatccggacagattgtataagtatgcaactaagctgaagaaaaactgtaaggaaataactgataaggaattggacaagaaaatgaaggagctcgccgccgtcatgagcgaccctgacctggaaactgagactatgtgcctccacgacgacgagtcgtgtcgctacgaagggcaagtcgctgtttaccaggatgtatacgcggttgacggaccgacaagtctctatcaccaagccaataagggagttagagtcgcctactggataggctttgacaccaccccttttatgtttaagaacttggctggagcatatccatcatactctaccaactgggccgacgaaaccgtgttaacggctcgtaacataggcctatgcagctctgacgttatggagcggtcacgtagagggatgtccattcttagaaagaagtatttgaaaccatccaacaatgttctattctctgttggctcgaccatctaccacgagaagagggacttactgaggagctggcacctgccgtctgtatttcacttacgtggcaagcaaaattacacatgtcggtgtgagactatagttagttgcgacgggtacgtcgttaaaagaatagctatcagtccaggcctgtatgggaagccttcaggctatgctgctacgatgcaccgcgagggattcttgtgctgcaaagtgacagacacattgaacggggagagggtctcttttcccgtgtgcacgtatgtgccagctacattgtgtgaccaaatgactggcatactggcaacagatgtcagtgcggacgacgcgcaaaaactgctggttgggctcaaccagcgtatagtcgtcaacggtcgcacccagagaaacaccaataccatgaaaaattaccttttgcccgtagtggcccaggcatttgctaggtgggcaaaggaatataaggaagatcaagaagatgaaaggccactaggactacgagatagacagttagtcatggggtgttgttgggcttttagaaggcacaagataacatctatttataagcgcccggatacccaaaccatcatcaaagtgaacagcgatttccactcattcgtgctgcccaggataggcagtaacacattggagatcgggctgagaacaagaatcaggaaaatgttagaggagcacaaggagccgtcacctctcattaccgccgaggacgtacaagaagctaagtgcgcagccgatgaggctaaggaggtgcgtgaagccgaggagttgcgcgcagctctaccacctttggcagctgatgttgaggagcccactctggaagccgatgtcgacttgatgttacaagaggctggggcc

SEQ ID NO: 996 - DNA, 798 bp, Artificial Sequence
  KanR
atgattgaacaggatggcctgcatgcgggtagcccggcagcgtgggtggaacgtctgtttggctatgattgggcgcagcagaccattggctgctctgatgcggcggtgtttcgtctgagcgcgcagggtcgtccggtgctgtttgtgaaaaccgatctgagcggtgcgctgaacgagctgcaggatgaagcggcgcgtctgagctggctggccaccaccggtgttccgtgtgcggcggtgctggatgtggtgaccgaagcgggccgtgattggctgctgctgggcgaagtgccgggtcaggatctgctgtctagccatctggcgccggcagaaaaagtgagcattatggcggatgccatgcgtcgtctgcataccctggacccggcgacctgtccgtttgatcatcaggcgaaacatcgtattgaacgtgcgcgtacccgtatggaagcgggcctggtggatcaggatgatctggatgaagaacatcagggcctggcaccggcagagctgtttgcgcgtctgaaagcgagcatgccggatggcgaagatctggtggtgacccatggtgatgcgtgcctgccgaacattatggtggaaaatggccgttttagcggctttattgattgcggccgtctgggcgtggcggatcgttatcaggatattgcgctggccacccgtgatattgcggaagaactgggcggcgaatgggcggatcgttttctggtgctgtatggcattgcggcaccggatagccagcgtattgcgttttatcgtctgctggatgaatttttctaataa

SEQ ID NO: 997 - DNA, 192 bp, Artificial Sequence
  Rop
gtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctga

SEQ ID NO: 998 - DNA, 44 bp, Artificial Sequence
  5' UTR
ataggcggcgcatgagagaagcccagaccaattacctacccaaa

SEQ ID NO: 999 - DNA, 117 bp, Artificial Sequence
  3' UTR
atacagcagcaattggcaagctgcttacatagaactcgcggcgattggcatgccgctttaaaatttttattttatttttcttttcttttccgaatcggattttgtttttaatatttc

What is claimed:

1. A method of treating a prostate cancer in a subject, the method comprising administering to the subject:

a) first vaccine comprising an Ad26 vector comprising a polynucleotide encoding the polypeptides of SEQ ID NOs: 275, 381, 333, 337, 269, 253, 309, 325, 271, 305, 251, 245, 261, 265, 317, 255, 297, 285, 437, 439, 442, 444, 379, 343, 211, 349, 213, 215, 221, 219, 225, 345, 353, 235, 223, 167, 171, 19, 23, and 177; and b) a second vaccine comprising a self-replicating RNA molecule comprising a polynucleotide encoding the polypeptides of SEQ ID NOs: 275, 381, 333, 337, 269, 253, 309, 325, 271, 305, 251, 245, 261, 265, 317, 255, 297, 285, 437, 439, 442, 444, 379, 343, 211, 349, 213, 215, 221, 219, 225, 345, 353, 235, 223, 167, 171, 19, 23, and 177.

2. The method of claim 1, wherein the self-replicating RNA molecule is an alphavirus.

3. The method of claim 2, wherein the alphavirus is Eastern equine encephalitis virus (EEEV), Venezuelan equine encephalitis virus (VEEV), Everglades virus (EVEV), Mucambo virus (MUCV), Semliki forest virus (SFV), Pixuna virus (PIXV), Middelburg virus (MIDV), Chikungunya virus (CHIKV), O'Nyong-Nyong virus (ONNV), Ross River virus (RRV), Barmah Forest virus (BF), Getah virus (GET), Sagiyama virus (SAGV), Bebaru virus (BEBV), Mayaro virus (MAYV), Una virus (UNAV), Sindbis virus (SINV), Aura virus (AURAV), Whataroa virus (WHAV), Babanki virus (BABV), Kyzylagach virus (KYZV), Western equine encephalitis virus (WEEV), Highland J virus (HJV), Fort Morgan virus (FMV), Ndumu (NDUV), or Buggy Creek virus.

4. The method of claim 3, wherein the alphavirus is a Venezuelan equine encephalitis virus (VEEV).

5. The method of claim 1, wherein the prostate cancer is a relapsed prostate cancer, a refractory prostate cancer, a metastatic prostate cancer, a castration resistant prostate cancer, or any combination thereof.

6. The method of claim 1, comprising administering an additional cancer therapeutic agent to the subject.

7. The method of claim 1, wherein the first vaccine is administered one or more times to the subject.

8. The method of claim 1, wherein the second vaccine is administered one or more times to the subject.

9. The method of claim 1, wherein the first vaccine is administered about 1-16 weeks prior to administering the second vaccine.

* * * * *